US012570760B2

(12) United States Patent
Pszolla et al.

(10) Patent No.: US 12,570,760 B2
(45) **Date of Patent: *Mar. 10, 2026**

(54) ANTIGEN BINDING PROTEINS SPECIFICALLY BINDING PRAME

(71) Applicant: Immatics Biotechnologies GmbH, Tuebingen (DE)

(72) Inventors: Gabriele Pszolla, Tuebingen (DE); Martin Hofmann, Tuebingen (DE); Meike Hutt, Tuebingen (DE); Sebastian Bunk, Tuebingen (DE); Felix Unverdorben, Tuebingen (DE); Frank Schwoebel, Tuebingen (DE); Dominik Maurer, Tuebingen (DE); Maike Jaworski, Tuebingen (DE); Claudia Wagner, Tuebingen (DE); Florian Schwoerer, Tuebingen (DE); Heiko Schuster, Tuebingen (DE)

(73) Assignee: Immatics Biotechnologies GmbH, Tuebingen (DE)

( * ) Notice: Subject to any disclaimer, the term of this patent is extended or adjusted under 35 U.S.C. 154(b) by 635 days.

This patent is subject to a terminal disclaimer.

(21) Appl. No.: 17/736,882

(22) Filed: May 4, 2022

(65) Prior Publication Data

US 2022/0372165 A1 Nov. 24, 2022

Related U.S. Application Data

(60) Provisional application No. 63/184,689, filed on May 5, 2021.

(30) Foreign Application Priority Data

May 5, 2021 (EP) ..................................... 21172351

(51) Int. Cl.
| | |
|---|---|
| *C07K 16/30* | (2006.01) |
| *A61K 39/00* | (2006.01) |
| *C07K 16/28* | (2006.01) |
| *C07K 16/46* | (2006.01) |

(52) U.S. Cl.
CPC ...... *C07K 16/30* (2013.01); *A61K 39/001189* (2018.08); *C07K 16/2809* (2013.01); *C07K 16/468* (2013.01); *C07K 2317/24* (2013.01); *C07K 2317/31* (2013.01); *C07K 2317/565* (2013.01); *C07K 2317/73* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 4,861,719 A | 8/1989 | Miller | |
| 4,975,278 A | 12/1990 | Senter | |
| 5,202,238 A | 4/1993 | Fell, Jr. | |
| 5,208,020 A | 5/1993 | Chari | |
| 5,278,056 A | 1/1994 | Bank | |
| 5,731,168 A | 3/1998 | Carter | |
| 5,789,208 A | 8/1998 | Sharon | |
| 5,882,877 A | 3/1999 | Gregory | |
| 6,013,516 A | 1/2000 | Verma | |
| 6,335,163 B1 | 1/2002 | Sharon | |
| 6,805,861 B2 | 10/2004 | Stauss | |
| 7,329,731 B2 | 2/2008 | Jakobsen et al. | |
| 7,511,118 B2 | 3/2009 | Liu et al. | |
| 7,511,119 B2 | 3/2009 | Liu et al. | |
| 7,605,227 B2 | 10/2009 | Liu et al. | |
| 7,741,465 B1 | 6/2010 | Eshhar et al. | |
| 7,763,718 B2 | 7/2010 | Jakobsen et al. | |
| 7,811,828 B2 | 10/2010 | Lemmel | |
| 7,999,088 B2 | 8/2011 | Qiu et al. | |
| 8,084,592 B2 | 12/2011 | Bot et al. | |

(Continued)

FOREIGN PATENT DOCUMENTS

| | | |
|---|---|---|
| DE | 102020106710 | 9/2021 |
| EP | 1075496 A1 | 2/2001 |

(Continued)

OTHER PUBLICATIONS

Frank et al. Princeton University Press, 2002 (Year: 2002).*
Van Regenmortel (Journal of Immunological Methods, 1998, 216:37-48) (Year: 1998).*
Hasegawa et al. (mAbs 2017, 9(5) 854-873) (Year: 2017).*
Aleksic et al., "Different affinity windows for virus and cancer-specific T-cell receptors—implications for therapeutic strategies," Eur J Immunol. Dec. 2012; vol. 42, No. 12, pp. 3174-3179.
Kessler et al., "Efficient Identification of Novel HLA-A*0201-presented Cytotoxic T Lymphocyte Epitopes in the Widely Expressed Tumor Antigen PRAME by Proteasome-mediated Digestion Analysis," J. Exp. Med., vol. 193, No. 1, Jan. 1, 2001 pp. 73-88.

(Continued)

*Primary Examiner* — Meera Natarajan
(74) *Attorney, Agent, or Firm* — McBee Moore & Vanik IP, LLC

(57) ABSTRACT

The present invention concerns antigen binding proteins directed against PRAME protein-derived antigens. The invention in particular provides antigen binding proteins which are specific for the tumor expressed antigen PRAME, wherein the tumor antigen comprises or consists of SEQ ID NO: 50 and is in a complex with a major histocompatibility complex (MHC) protein. The antigen binding proteins of the invention contain, in particular, the complementary determining regions (CDRs) of novel engineered T cell receptors (TCRs) that specifically bind to said PRAME peptide. The antigen binding proteins of the invention are for use in the diagnosis, treatment and prevention of PRAME expressing cancerous diseases. Further provided are nucleic acids encoding the antigen binding proteins of the invention, vectors comprising said nucleic acids, recombinant cells expressing the antigen binding proteins and pharmaceutical compositions comprising the antigen binding proteins of the invention.

29 Claims, 23 Drawing Sheets

Specification includes a Sequence Listing.

(56) References Cited

U.S. PATENT DOCUMENTS

| | | |
|---|---|---|
| 8,088,379 B2 | 1/2012 | Robbins et al. |
| 8,124,408 B2 | 2/2012 | Cai et al. |
| 8,211,422 B2 | 7/2012 | Eshhar et al. |
| 8,357,533 B2 | 1/2013 | Cai et al. |
| 8,465,743 B2 | 6/2013 | Rosenberg et al. |
| 8,653,237 B2 | 2/2014 | Liu et al. |
| 8,674,081 B2 | 3/2014 | Qiu et al. |
| 8,822,196 B2 | 9/2014 | Rosenberg et al. |
| 9,005,927 B2 | 4/2015 | Hufton et al. |
| 9,012,181 B2 | 4/2015 | Hufton et al. |
| 9,034,601 B2 | 5/2015 | Hufton et al. |
| 9,040,258 B2 | 5/2015 | Hufton et al. |
| 9,040,669 B2 | 5/2015 | Cheung et al. |
| 9,068,980 B2 | 6/2015 | Hufton et al. |
| 9,116,149 B2 | 8/2015 | Hufton et al. |
| 9,128,080 B2 | 9/2015 | Robbins et al. |
| 9,453,075 B2 | 9/2016 | Cheung et al. |
| 9,522,955 B2 | 12/2016 | Rosenberg et al. |
| 9,556,428 B2 | 1/2017 | Hufton et al. |
| 9,556,438 B2 | 1/2017 | Naldini et al. |
| 9,764,037 B2 | 9/2017 | Anderson et al. |
| 9,791,444 B2 | 10/2017 | Weinschenk |
| 9,803,246 B2 | 10/2017 | Sugiyama |
| 10,059,936 B2 | 8/2018 | Hufton et al. |
| 10,093,977 B2 | 10/2018 | Sugiyama |
| 10,098,941 B2 | 10/2018 | Bremer et al. |
| 10,106,805 B2 | 10/2018 | Spangenberg |
| 10,174,098 B2 | 1/2019 | Hinrichs et al. |
| 10,464,988 B2 | 11/2019 | Lu et al. |
| 10,479,975 B2 | 11/2019 | Friedman |
| 10,544,392 B2 | 1/2020 | Gros et al. |
| 10,577,599 B2 | 3/2020 | Hufton et al. |
| 10,611,816 B2 | 4/2020 | Tran et al. |
| 10,648,036 B2 | 5/2020 | Sugiyama |
| 10,669,584 B2 | 6/2020 | Sugiyama |
| 10,744,157 B2 | 8/2020 | Sentman et al. |
| 10,755,599 B2 | 8/2020 | Schilleci |
| 10,800,832 B2 | 10/2020 | Alten et al. |
| 10,822,389 B2 | 11/2020 | Lu et al. |
| 10,851,149 B2 | 12/2020 | Siegel et al. |
| 10,870,687 B2 | 12/2020 | Hinrichs et al. |
| 11,034,767 B2 | 6/2021 | Ackerman et al. |
| 11,047,011 B2 | 6/2021 | Han |
| 11,072,645 B2 | 7/2021 | Bunk et al. |
| 11,072,660 B2 | 7/2021 | Sissons et al. |
| 11,111,286 B2 | 9/2021 | Alten et al. |
| 11,208,456 B2 | 12/2021 | Tran et al. |
| 11,236,145 B2 | 2/2022 | Alten et al. |
| 11,242,376 B2 | 2/2022 | Baeuerle et al. |
| 11,325,961 B2 | 5/2022 | Ogasawara |
| 11,384,133 B2 | 7/2022 | Smith et al. |
| 11,384,144 B2 | 7/2022 | Scheinberg et al. |
| 11,427,624 B2 | 8/2022 | Addis et al. |
| 11,434,272 B2 | 9/2022 | Hinrichs et al. |
| 11,453,726 B2 | 9/2022 | Ali et al. |
| 11,629,334 B2 | 4/2023 | Gros |
| 11,639,374 B2 | 5/2023 | Chester |
| 11,643,451 B2 | 5/2023 | Stauss |
| 11,718,657 B2 | 8/2023 | Addis |
| 11,840,577 B2 | 12/2023 | Hutt |
| 11,845,796 B2 | 12/2023 | Xu |
| 11,851,673 B2 | 12/2023 | Mata |
| 11,897,933 B2 | 2/2024 | Tran |
| 11,952,408 B2 | 4/2024 | Brandt |
| 2008/0044484 A1 | 2/2008 | Minev |
| 2008/0187535 A1 | 8/2008 | Blais et al. |
| 2008/0206270 A1 | 8/2008 | Minev |
| 2010/0009863 A1 | 1/2010 | Himmler et al. |
| 2010/0105136 A1 | 4/2010 | Carter et al. |
| 2010/0297093 A1 | 11/2010 | Robbins et al. |
| 2010/0303842 A1 | 12/2010 | Liu et al. |
| 2010/0317546 A1 | 12/2010 | Enzelberger et al. |
| 2011/0045007 A1 | 2/2011 | Schuurman et al. |
| 2011/0189141 A1 | 8/2011 | Kieback et al. |
| 2011/0245153 A1 | 10/2011 | Kranz et al. |
| 2012/0294857 A1 | 11/2012 | Sentman et al. |
| 2013/0089554 A1 | 4/2013 | Blakenship et al. |
| 2013/0095097 A1 | 4/2013 | Blakenship et al. |
| 2013/0129723 A1 | 5/2013 | Blakenship et al. |
| 2015/0274844 A1 | 10/2015 | Blakenship et al. |
| 2016/0017048 A1 | 1/2016 | Dotti et al. |
| 2016/0187351 A1 | 6/2016 | Weinschenk |
| 2016/0199479 A1 | 7/2016 | Su et al. |
| 2016/0263155 A1 | 9/2016 | Heemskerk et al. |
| 2016/0317633 A1 | 11/2016 | Yee et al. |
| 2017/0226216 A1 | 8/2017 | Morgan et al. |
| 2018/0282390 A1 | 10/2018 | Voss et al. |
| 2018/0319862 A1 | 11/2018 | Thompson et al. |
| 2018/0355038 A1 | 12/2018 | Smith et al. |
| 2019/0002523 A1 | 1/2019 | Chester et al. |
| 2019/0016804 A1 | 1/2019 | Hofmann et al. |
| 2019/0031759 A1 | 1/2019 | Reiter et al. |
| 2019/0040378 A1 | 2/2019 | Fotin-Mleczek et al. |
| 2019/0111080 A1 | 4/2019 | Shah |
| 2019/0119399 A1 | 4/2019 | Abbot et al. |
| 2019/0119639 A1 | 4/2019 | Oelke et al. |
| 2019/0169261 A1 | 6/2019 | Ellinger et al. |
| 2019/0183936 A1 | 6/2019 | Shum et al. |
| 2019/0248865 A1 | 8/2019 | Lu et al. |
| 2019/0336531 A1 | 11/2019 | Stauss et al. |
| 2019/0338012 A1 | 11/2019 | Stauss et al. |
| 2020/0000898 A1 | 1/2020 | Yee et al. |
| 2020/0054678 A1 | 2/2020 | Heemskerk et al. |
| 2020/0079864 A1 | 3/2020 | Morgan et al. |
| 2020/0095548 A1 | 3/2020 | Gros et al. |
| 2020/0109365 A1 | 4/2020 | Friedman |
| 2020/0172619 A1 | 6/2020 | Richter et al. |
| 2020/0188435 A1 | 6/2020 | Oelke et al. |
| 2020/0207828 A1 | 7/2020 | Baeuerle et al. |
| 2020/0215115 A1 | 7/2020 | Oelke et al. |
| 2020/0230236 A1 | 7/2020 | Huang et al. |
| 2020/0261502 A1 | 8/2020 | Li et al. |
| 2020/0283495 A1 | 9/2020 | Liu et al. |
| 2020/0283524 A1 | 9/2020 | Xu et al. |
| 2020/0317777 A1 | 10/2020 | Sadelain et al. |
| 2020/0368283 A1 | 11/2020 | Sadelain et al. |
| 2020/0376031 A1 | 12/2020 | Mata et al. |
| 2020/0385472 A1 | 12/2020 | Loew et al. |
| 2021/0017249 A1 | 1/2021 | Sather et al. |
| 2021/0017599 A1 | 1/2021 | Sugiyama |
| 2021/0030804 A1 | 2/2021 | Sadelain et al. |
| 2021/0032361 A1 | 2/2021 | Hutt et al. |
| 2021/0040558 A1 | 2/2021 | Schumacher et al. |
| 2021/0041435 A1 | 2/2021 | Ogasawara |
| 2021/0130495 A1 | 5/2021 | Chand et al. |
| 2021/0147929 A1 | 5/2021 | DiPaolo et al. |
| 2021/0214436 A1 | 7/2021 | Chang et al. |
| 2021/0284709 A1 | 9/2021 | Brandt et al. |
| 2021/0285011 A1 | 9/2021 | Mata et al. |
| 2021/0300988 A1 | 9/2021 | Tran et al. |
| 2021/0355188 A1 | 11/2021 | Addis et al. |
| 2021/0363216 A1 | 11/2021 | Bossi et al. |
| 2021/0363258 A1 | 11/2021 | Sissons et al. |
| 2021/0369776 A1 | 12/2021 | Li et al. |
| 2021/0380659 A1 | 12/2021 | Bunk et al. |
| 2021/0395331 A1 | 12/2021 | Stauss et al. |
| 2022/0033461 A1 | 2/2022 | Voss et al. |
| 2022/0056411 A1 | 2/2022 | Kalra et al. |
| 2022/0089270 A1 | 3/2022 | Tran et al. |
| 2022/0098270 A1 | 3/2022 | Alten et al. |
| 2022/0118018 A1 | 4/2022 | Bae et al. |
| 2022/0162285 A1 | 5/2022 | Ali et al. |
| 2022/0202862 A1 | 6/2022 | Bajwa et al. |
| 2022/0267406 A1 | 8/2022 | Stauss et al. |
| 2022/0275043 A1 | 9/2022 | Irvine et al. |
| 2023/0082787 A1 | 3/2023 | Levin |
| 2023/0151061 A1 | 5/2023 | De Groot |
| 2023/0159614 A1 | 5/2023 | Levin |
| 2023/0190915 A1 | 6/2023 | De Groot |

(56) References Cited

U.S. PATENT DOCUMENTS

| | | |
|---|---|---|
| 2023/0242591 A1 | 8/2023 | De Groot |
| 2023/0287079 A1 | 9/2023 | Kula |

FOREIGN PATENT DOCUMENTS

| | | |
|---|---|---|
| EP | 2970484 A1 | 1/2016 |
| WO | 8101145 A1 | 4/1981 |
| WO | 8807378 A1 | 10/1988 |
| WO | 9419478 A1 | 9/1994 |
| WO | 9514785 A1 | 6/1995 |
| WO | 9622378 A1 | 7/1996 |
| WO | 9710354 A1 | 3/1997 |
| WO | 0148145 A2 | 7/2001 |
| WO | 03100432 A2 | 12/2003 |
| WO | 2004044004 A2 | 5/2004 |
| WO | 2004091668 A1 | 10/2004 |
| WO | 2005076009 A2 | 8/2005 |
| WO | 2011044186 A1 | 4/2011 |
| WO | 2011128448 A1 | 10/2011 |
| WO | 2012135345 A1 | 10/2012 |
| WO | 2013/041865 | 3/2013 |
| WO | 2014018863 A1 | 1/2014 |
| WO | 2016107740 A1 | 7/2016 |
| WO | 2016116626 A1 | 7/2016 |
| WO | 2016191246 A2 | 12/2016 |
| WO | WO2018/172533 * | 3/2018 |
| WO | 2018091396 A1 | 5/2018 |
| WO | 2018104407 A1 | 6/2018 |
| WO | 2018/172533 A2 | 9/2018 |
| WO | 2018234319 | 12/2018 |
| WO | 2019/158084 | 8/2019 |
| WO | 2019204662 | 10/2019 |
| WO | 2020010250 | 1/2020 |
| WO | 2020021045 | 1/2020 |
| WO | 2020048990 | 3/2020 |
| WO | 2020057610 A1 | 3/2020 |
| WO | 2020081537 | 4/2020 |
| WO | 2020123938 | 6/2020 |
| WO | 2020146431 | 7/2020 |
| WO | 2020186158 | 9/2020 |
| WO | 2020186204 | 9/2020 |
| WO | 2020191358 | 9/2020 |
| WO | 2020216238 | 10/2020 |
| WO | 2020229553 A1 | 11/2020 |
| WO | 2021013932 | 1/2021 |
| WO | 2021016174 | 1/2021 |
| WO | 2021016609 | 1/2021 |
| WO | 2021046072 A1 | 3/2021 |
| WO | 2021058807 A1 | 4/2021 |
| WO | 2021078774 A1 | 4/2021 |
| WO | 2021097365 A2 | 5/2021 |
| WO | 2021099360 A1 | 5/2021 |
| WO | 2021127184 A1 | 6/2021 |
| WO | 2021129559 A1 | 7/2021 |
| WO | 2021/163398 | 8/2021 |
| WO | 2021/163427 | 8/2021 |
| WO | 2021/163456 | 8/2021 |
| WO | 2021/163477 | 8/2021 |
| WO | 2021/173902 | 9/2021 |
| WO | 2021188599 A1 | 9/2021 |
| WO | 2021188601 A1 | 9/2021 |
| WO | 2021/211455 | 10/2021 |
| WO | 2021222576 A1 | 11/2021 |
| WO | 2021248198 A1 | 12/2021 |
| WO | 2022/008418 | 1/2022 |
| WO | 2022/020319 | 1/2022 |
| WO | 2022026358 A1 | 2/2022 |
| WO | 2022076788 A1 | 4/2022 |
| WO | 2022083668 A1 | 4/2022 |
| WO | 2022/111451 | 6/2022 |
| WO | 2022133592 A1 | 6/2022 |
| WO | 2022150610 | 7/2022 |
| WO | 2022178367 A2 | 8/2022 |
| WO | 2023076875 A1 | 5/2023 |
| WO | 2023139289 A1 | 7/2023 |
| WO | 2023173024 A2 | 9/2023 |

OTHER PUBLICATIONS

Hickman et al., "Antigen Selection for Enhanced Affinity T-Cell Receptor-Based Cancer Therapies," Journal of Bio molecular Screening, 2016, vol. 21, No. 8, pp. 769-785.

Linette et al., "Cardiovascular toxicity and titin cross-reactivity of affinity-enhanced T cells inmyeloma and melanoma," Blood, Aug. 8, 2013, vol. 122 No. 6, pp. 863-871.

Cameron et al., "Identification of a Titin-Derived HLA-A1-Presented Peptide as a Cross-Reactive Target for Engineered MAGE A3-Directed T Cells," Sci Transl Med., Aug. 7, 2013, vol. 5, No. 197, 26 pages.

PCT International Search Report and Written Opinion for PCT/EP2022/062017, mailed Jul. 15, 2022.

Kessler, et al., "Efficient identification of novel HLA-A(*)0201-presented cytotoxic T lymphocyte epitopes in the widely expressed tumor antigen PRAME by proteasome-mediated digestion analysis," J Exp Med, Jan. 1, 2001;193(1):73-88.

Aleksic, et al., "Different affinity windows for virus and cancer-specific T-cell receptors: implications for therapeutic strategies," Eur J Immunol, Dec. 2012;42(12):3174-9.

Hickman, et al., "Antigen Selection for Enhanced Affinity T-Cell Receptor-Based Cancer Therapies," J Biomol Screen, Sep. 2016;21(8):769-85.

Linette, et al., "Cardiovascular toxicity and titin cross-reactivity of affinity-enhanced T cells in myeloma and melanoma," Blood, Aug. 8, 2013;122(6):863-71.

Cameron, et al., "Identification of a Titin-derived HLA-A1-presented peptide as a cross-reactive target for engineered MAGE A3-directed T cells," Sci Transl Med, Aug. 7, 2013;5(197):197ra103.

Ikeda, et al., "Characterization of an antigen that is recognized on a melanoma showing partial HLA loss by CTL expressing an NK inhibitory receptor," Immunity, Feb. 1997;6(2):199-208.

Uniprot, Database accession No. P78395.

Schlapschy, et al., "PASylation: a biological alternative to PEGylation for extending the plasma half-life of pharmaceutically active proteins," Protein Eng Des Sel, Aug. 2013;26(8):489-501.

Jevsevar, et al., "PEGylation of therapeutic proteins," Biotechnol J, Jan. 2010;5(1):113-28 (Abstract provided).

Dozier, et al., "Site-Specific PEGylation of Therapeutic Proteins," Int J Mol Sci, Oct. 28, 2015;16(10):25831-64.

Kirin, et al., "Amino acid and peptide bioconjugates of copper(II) and zinc(II) complexes with a modified N,N-bis(2-picolyl)amine ligand," Inorg Chem, Jul. 25, 2005;44(15):5405-15 (Abstract provided.).

Hudecz, F., "Synthesis of peptide bioconjugates," Methods Mol Biol, 2005:298:209-23 (Abstract provided.).

Jones, AJS, "Analysis of polypeptides and proteins," Advanced Drug Delivery Reviews vol. 10, Issue 1, Jan.-Apr. 1993, pp. 29-90 (Abstract provided.).

Shearman, et al., "Construction, expression and characterization of humanized antibodies directed against the human alpha/beta T cell receptor," J Immunol, Dec. 15, 1991;147(12):4366-73 (Abstract provided.).

Zhao, et al., "High-affinity TCRs generated by phage display provide CD4+ T cells with the ability to recognize and kill tumor cell lines," J Immunol, Nov. 1, 2007; 179(9):5845-54.

Epping, et al., "The human tumor antigen PRAME is a dominant repressor of retinoic acid receptor signaling," Cell, Sep. 23, 2005;122(6):835-47.

Epping, et al., "A causal role for the human tumor antigen preferentially expressed antigen of melanoma in cancer," Cancer Res, Nov. 15, 2006;66(22):10639-42.

Mitsuhashi, et al., "Prognostic significance of PRAME expression based on immunohistochemistry for diffuse large B-cell lymphoma patients treated with R-CHOP therapy," Int J Hematol, Jul. 2014;100(1):88-95 (Abstract provided.).

(56) References Cited

OTHER PUBLICATIONS

Doolan, et al., "Prevalence and prognostic and predictive relevance of PRAME in breast cancer," Breast Cancer Res Treat, May 2008;109(2):359-65 (Abstract provided.).

Wilson, et al., "Specificity and degeneracy of T cells," Mol Immunol, Feb. 2004;40(14-15):1047-55 (Abstract provided.).

Richman, et al., "Structural features of T cell receptor variable regions that enhance domain stability and enable expression as single-chain ValphaVbeta fragments,".

Jendeberg, et al., "Engineering of Fc(1) and Fc(3) from human immunoglobulin G to analyse subclass specificity for staphylococcal protein A," J Immunol Methods, Feb. 14, 1997;201(1):25-34.

Edelman, et al., "The covalent structure of an entire gammaG immunoglobulin molecule," Proc Natl Acad Sci U S A, May 1969;63(1):78-85.

Wooldridge, et al., "A single autoimmune T cell receptor recognizes more than a million different peptides," J Biol Chem, Jan. 6, 2012;287(2):1168-77.

Wei, et al., "Structural basis of a novel heterodimeric Fc for bispecific antibody production," Oncotarget, May 2, 2017;8(31):51037-51049.

Szczepanski, et al., "PRAME expression in head and neck cancer correlates with markers of poor prognosis and might help in selecting candidates for retinoid chemoprevention in pre-malignant lesions," Oral Oncol . Feb. 2013;49(2):144-51.

Van Baren, et al., "PRAME, a gene encoding an antigen recognized on a human melanoma by cytolytic T cells, is expressed in acute leukaemia cells," Br J Haematol, Sep. 1998; 102(5):1376-9 (Abstract provided.).

Lefranc, et al. "IMGT unique numbering for immunoglobulin and T cell receptor variable domains and Ig superfamily V-like domains," Dev Comp Immunol, Jan. 2003;27(1):55-77.

Scaviner & Lefranc, Exp Clin Immunogenet, vol. 17, No. 2, 2000, pp. 83-96.

Lefranc, et al., "IMGT®, the international ImMunoGeneTics information system® 25 years on," Nucleic Acids Research, vol. 43, Issue D1, Jan. 28, 2015, pp. D413-D422.

Stadinski, et al., "A temporal thymic selection switch and ligand binding kinetics constrain neonatal Foxp3+ Treg cell development," Nat Immunol, Aug. 2019;20(8):1046-1058.

Cole, S., "Multidrug resistance protein 1 (MRP1, ABCC1), a "multitasking" ATP-binding cassette (ABC) transporter," J Biol Chem, Nov. 7, 2014;289(45):30880-8.

Birnbaum, et al., "Molecular architecture of the αβ T cell receptor-CD3 complex", Proc. Natl. Acad. Sci. U.S.A. 111(49) 17576-17581.

Brinkmann, et al., "The making of bispecific antibodies," MAbs. Feb./Mar. 2017;9(2):182-212.

Wu, et al., "Simultaneous targeting of multiple disease mediators by a dual-variable-domain immunoglobulin," NAT Biotechnol, vol. 25, 2007, pp. 1290-1297.

Craig, et al., Anti-HIV Double Variable Domain Immunoglobulins Binding Both gp41 and gp120 for Targeted Delivery of Immunoconjugates, PLOS ONE, vol. 7, 2012, 46778.

Onuoha, et al., "Rational design of antirheumatic prodrugs specific for sites of inflammation," Arthritis Rheumatol, Oct. 2015;67(10):2661-72.

Holliger, et al., "Specific killing of lymphoma cells by cytotoxic T-cells mediated by a bispecific diabody," Protein Engineering, vol. 9, Issue 3, Mar. 1996, pp. 299-305 (Abstract provided.).

Guo, et al., "Protein tolerance to random amino acid change," Proc Natl Acad Sci U S A . Jun. 22, 2004;101(25):9205-10 (Abstract provided.).

Needleman, et al., "A general method applicable to the search for similarities in the amino acid sequence of two proteins," J Mol Biol . Mar. 1970;48(3):443-53 (Abstract provided).

Almagro, et al., "Humanization of antibodies," Front Biosci, Jan. 1, 2008:13:1619-33.

Atwell, et al., "Design and expression of a stable bispecific scFv dimer with affinity for both glycophorin and N9 neuraminidase," Molecular Immunology, vol. 33, Issues 17-18, Dec. 1996, pp. 1301-1312.

Kontermann, et al., "Enzyme immunoassays using bispecific diabodies," Immunotechnology. Jun. 1997;3(2):137-44.

Kontermann, et al., "Complement recruitment using bispecific diabodies," Nat Biotechnol, Jul. 1997;15(7):629-31 (Abstract provided.).

Cochlovius, et al., "Cure of Burkitt's Lymphoma in Severe Combined Immunodeficiency Mice by T Cells, Tetravalent CD3 × CD19 Tandem Diabody, and CD28 Costimulation," Cancer Res (2000) 60 (16): 4336-4341.

DeNardo, et al., "Anti-HLA-DR/anti-DOTA Diabody Construction in a Modular Gene Design Platform: Bispecific Antibodies for Pretargeted Radioimmunotherapy," Cancer Biotherapy & Radiopharmaceuticals, vol. 16, No. 6, Published Online: Jul. 5, 2004 (Abstract provided.).

E. P. Altshuler, D. V. Serebryanaya, and A. G. Katrukha. Preparation of recombinant antibodies and methods of increasing their affinity. Successes in Biological Chemistry, vol. 50, 2010, pp. 203-258 ( Е.П.Альтшулер, Д.В. Серебряная, А.Г.Катруха " Получение рекомбинантных антител и способы увеличения их аффинности ", Успехи биологической химии, ТОМ 50, 2010, с. 203-258) (with English Abstract).

Khaitov R.M., Ignatieva G.A., Sidorovich I.G. Immunology: Textbook. Moscow. Medicine, 2000, 432 pages Хаитов Р Игнатьева Г.А. Сидорович И.Г Иммунология: учебник Москва: Медицина 2020. —432 с.) (with English Abstract).

Koiko, R. Immunology: Textbook. / Coico R., Sunshine G., Benjamini E. Translated from English by A.V. Kamaev, A. Yu. Kuznetsova, ed. by N.B. Serebryanaya. Moscow. Academia Publishing Center. 2008, 368 pages (Койко Р Иммунология учебное пособие Р.Койко Д. Саншайн Э.Бенджамини англ Ю. Кузнецовой под ред Б. Серебряной. Издательский центр Академия 2008.—368 с.) (with English Abstract).

* cited by examiner

Figure 1

R11P3D3_scTCR

R11P3D3SD_
stabilized scTCR

Myc tag 99.2

46.4

HLA-A*02/PRAME-004 tetramer

Figure 3

R11P3D3SDA7_B04_scTCR

TPP-70

TPP-71

TPP-72

TPP-73

TPP-74

TPP-105

TPP-876

TPP-666

TPP-879

TPP-214 w/o bispecific

—◯— TPP-230

--△-- TPP-871

···□·· TPP-666

--◇-- TPP-891

＊ no TCER tracheal smooth
muscle cells

—⊖— TPP-230
--△-- TPP-871
···□·· TPP-666
··◇·· TPP-891
  ✳ no TCER

HTSMC in medium 13a/LDH-AM

Hs695T in medium 13a/LDH-AM

Figure 13

ANTIGEN BINDING PROTEINS SPECIFICALLY BINDING PRAME

CROSS REFERENCE TO RELATED APPLICATIONS

This application claims priority to U.S. Provisional Patent Application No. 63/184,689, filed May 5, 2021 and European Application No. 21172351.5, filed May 5, 2021, each of these applications is incorporated by reference in their entirety.

REFERENCE TO SEQUENCE LISTING SUBMITTED AS A COMPLIANT ASCII TEXT FILE (.txt)

Pursuant to the EFS-Web legal framework and 37 CFR §§ 1.821-5 825 (see MPEP § 2442.03(a)), a Sequence Listing in the form of an ASCII-compliant text file (entitled "3000058-018001 Sequence Listing_1017-29 ST25.txt" created on 4 May 2022, and 635,847 bytes in size) is submitted concurrently with the instant application, and the entire contents of the Sequence Listing are incorporated herein by reference.

The present invention concerns antigen binding proteins directed against PRAME protein-derived antigens. The invention in particular provides antigen binding proteins which are specific for the tumor expressed antigen PRAME, wherein the tumor antigen comprises or consists of SEQ ID NO: 50 and is in a complex with a major histocompatibility complex (MHC) protein. The antigen binding proteins of the invention contain, in particular, the complementary determining regions (CDRs) of novel engineered T cell receptors (TCRs) that specifically bind to said PRAME peptide. The antigen binding proteins of the invention are for use in the diagnosis, treatment and prevention of PRAME expressing cancerous diseases. Further provided are nucleic acids encoding the antigen binding proteins of the invention, vectors comprising said nucleic acids, recombinant cells expressing the antigen binding proteins and pharmaceutical compositions comprising the antigen binding proteins of the invention.

PRAME refers to "Preferentially Expressed Antigen in Melanoma" and belongs to the family of germline-encoded antigens known as cancer testis antigens. Cancer testis antigens are targets for immunotherapeutic intervention. PRAME is expressed in a number of solid tumors as well as in leukemia and lymphomas. The peptide SLLQHLIGL (SEQ ID NO: 50), also referred to as PRAME-004, corresponds to amino acids 425-433 of the full length PRAME protein (SEQ ID NO: 328) and said peptide is presented on the cell surface in complex with an MHC molecule, in particular HLA-A*02 (Kessler et al., J Exp Med. 2001 Jan. 1; 193(1):73-88). Peptide epitopes presented by MHC molecules may be bound by TCRs.

While advances have been made in the development of molecular-targeting drugs for cancer therapy, there remains a need in the art to develop new anti-cancer agents that specifically target molecules highly specific to cancer cells but not normal tissue cells. Since the PRAME-004 peptide is specifically expressed on tumors, it is a target for T cell-based immunotherapy.

WO2018/172533 discloses TCRs, including TCR R11P3D3, that bind to the PRAME-004 peptide in a complex with a MHC protein complex and the use of said TCRs in the diagnosis, treatment and prevention of cancerous diseases that (over)express PRAME. However, these TCRs have not been engineered in the CDR regions to bind to the target antigen with increased affinity.

Native TCRs bind to MHC presented antigens typically with low affinity ($K_D$=300 μM to 1 μM) whereby binding to MHC presented cancer self antigens is rarely observed with affinities higher than 10 μM, in contrast to viral foreign antigens for which TCR binding affinities in the range of 1-10 μM are well established (Aleksic et al. 2012, Eur J Immunol. 2012 December; 42(12):3174-9). Part of the explanation for this phenomenon is that T cells that develop in the thymus are negatively selected on self-peptide-MHC ligands, such that T cells with too high affinity against such self-peptide-MHCs are deleted (tolerance induction). This low affinity of TCRs towards cancer self antigens may be one possible explanation for tumor immune escape (Aleksic et al. 2012, Eur J Immunol. 2012 December; 42(12):3174-9). Therefore, it appears a desirable strategy to design TCR variants that bind with higher affinity to cancer self antigens for use as antigen recognizing constructs in an adoptive cell therapy (ACT). Furthermore, engineering of high affinity TCR variants that can be expressed as soluble protein would be desired for targeting cancer self antigens with soluble therapeutics, i.e. by using bispecific molecules (Hickman et al. 2016, J Biomol Screen. 2016 September; 21(8):769-85).

However, increasing the affinity of TCRs may also increase the risk of side effects. As mentioned above, in nature high affinity TCRs directed against tumor-associated antigens, which are self-proteins, are preluded by thymic selection, to avoid recognition of self-peptides present on normal tissue through cross-reactivity. Accordingly, simply increasing the TCRs affinity for its target sequence is likely to also increase the affinity to similar non cancer-specific peptides and therefore increasing the risk of cross-reactivity and unwanted cytotoxic effects on healthy tissue. That this is not just a theoretic risk has been painfully discovered for engineered TCRs targeting MAGE-A3. In particular, previously published results have shown lethal toxicities in two patients, who were infused with T cells engineered to express a TCR targeting MAGE-A3 cross-reacting with a peptide from the muscle protein Titin, even though no cross-reactivity had been predicted in the pre-clinical studies (Linette G P et al. Blood 2013; 122:863-71, Cameron B J, et al. Sci. Trans. Med. 2013; 5: 197-103). These patients demonstrated that TCR-engineered T cells can have serious and unpredictable off-target and organ-specific toxicities.

Accordingly, there is an unmet medical need to develop and provide antigen binding proteins specifically binding to their target with higher affinity, thus allowing to target even a tumor cell or cell lines with reduced expression of the target antigenic peptide, while a high safety profile is maintained due to a low or reduced cross-reactivity with potential off-target peptides (also referred to as "similar peptides" or "SimPeps"). Such antigen binding proteins should ideally also have good metabolic and/or pharmacokinetic profiles, and should be suitable to be manufactured in large scale compatible with industrial practice.

Accordingly, the inventors engineered antigen binding proteins specific for the PRAME-004 peptide comprising CDR variants derived from parental TCR R11P303. The herein provided antigen binding proteins have an increased binding affinity for the peptide-MHC complex and an increased stability, such as reduced aggregation during expression and/or purification, and/or an increased solubility, making them more suitable for a medical use.

Furthermore, the antigen binding proteins of the invention, in particular bispecific T cell engaging receptors (TCER®), exert high cytotoxicity against PRAME-004 positive tumor cells, e.g. cell lines Hs695T and U2OS cells, wherein the half maximal effective concentration ($EC_{50}$) is between 1 to 1000 pM. The $EC_{50}$ is 100-fold, preferably more than 1000-fold, higher than for PRAME-004 negative tumor cells, e.g. cell line 198G, demonstrating the increased safety of the antigen binding proteins of the invention.

Furthermore, the inventors demonstrated significant tumor growth inhibition in a therapeutic in vivo mouse model for antigen binding proteins of the invention, at low doses.

In summary, the surprising findings of the inventors provide inter cilia the following advantages over the art: provision of antigen binding molecule with (i) increased affinity for their target peptide while maintaining high tumor selectivity; (ii) increased specificity/reduced cross-reactivity, leading to reduced off-target and off-tumor cytotoxicity and an overall improved safety profile; (iii) increased stability; (iv) improved expression yield and solubility suitable for large-scale production; and (v) decreased immunogenicity.

SUMMARY

In a first aspect, the invention relates to an antigen binding protein specifically binding to a PRAME antigenic peptide that comprises or consists of the amino acid sequence SLLQHLIGL of SEQ ID NO: 50 and is in a complex with a major histocompatibility complex (MHC) protein, the antigen binding protein comprising (a) a first polypeptide comprising a variable domain $V_A$ comprising complementarity determining regions (CDRs) CDRa1, CORa2 and CDRa3, wherein the CDRa1 comprises or consists of the amino acid sequence VKEFQD (SEQ ID NO: 16), or an amino acid sequence differing from SEQ ID NO: 16 by one, two or three amino acid mutations, preferably amino acid substitutions, and the CDRa3 comprises or consists of the amino acid sequence ALYNNLDMR (SEQ ID NO: 33) or ALYNNYDMR (SEQ ID NO: 34), or an amino acid sequence differing from SEQ ID NO: 33 or SEQ ID NO: 34 by one, two or three, preferably one or two, amino acid mutations, preferably amino acid substitutions, and (b) a second polypeptide comprising a variable domain $V_B$ comprising CDRb1, CDRb2 and CDRb3, wherein the CDRb1 comprises or consists of the amino acid sequence SGHNS (SEQ ID NO: 10) or an amino acid sequence differing from SEQ ID NO: 10 by one or two amino acid mutations, preferably amino acid substitutions, and the CDRb3 comprises or consists of the amino acid sequence ASSX$_1$GX$_2$X$_3$DX$_4$QY (SEQ ID NO: 327), wherein X$_1$ is P, A or T, X$_2$ is A or S, X$_3$ is T or I, and X$_4$ is K or A, or an amino acid sequence differing from SEQ ID NO: 327 by one, two or three amino acid mutations, preferably amino acid substitutions.

In a second aspect, the invention relates to an isolated nucleic acid comprising a sequence encoding the antigen binding protein of the first aspect of the invention.

In a third aspect, the invention relates to a vector comprising the nucleic acid of the second aspect of the invention.

In a fourth aspect, the invention relates to a host cell comprising the antigen binding protein of the first aspect, the nucleic acid of the second aspect or the vector of the third aspect of the invention.

In a fifth aspect, the invention relates to a pharmaceutical composition comprising the antigen binding protein of the first aspect, the nucleic acids of the second aspect, the vector of the third aspect, or the host cell of the fourth aspect, and a pharmaceutically acceptable carrier.

In a sixth aspect, the invention relates to a method of producing the antigen binding protein of the first aspect of the invention, comprising (a) providing a host cell, (b) providing a genetic construct comprising a coding sequence encoding the antigen binding protein of the first aspect of the invention, (c) introducing said genetic construct into said host cell, and (d) expressing said genetic construct by said host cell.

In a seventh aspect, the invention provides the antigen binding protein of the first aspect, the nucleic acid of the second aspect, the vector of the third aspect, the host cell of the fourth aspect, or the pharmaceutical composition of the fifth aspect for use in medicine, in particular for use in the diagnosis, prevention, and/or treatment of a proliferative disease.

Definitions

"PRAMS" or "preferentially Expressed Antigen In Melanoma" was first identified as an antigen that is over expressed in melanoma (Ikeda et al Immunity. 1997 February; 6(2): 199-208); it is also known as CT130, MAPE, OIP-4 and has the Uniprot accession number P78395 (as available on Jan. 11, 2019). The protein functions as a repressor of retinoic acid receptor signaling (Epping et al., Cell. 2005 Sep. 23; 122(6):835-47). PRAME belongs to the family of germline-encoded antigens known as cancer testis antigens. Cancer testis antigens are attractive targets for immunotherapeutic intervention since they typically have limited or no expression in normal adult tissues. PRAME is expressed in a number of solid tumors as well as in leukemia and lymphomas (Doolan et al., Breast Cancer Res Treat. 2008 May; 109(2):359-65; Epping et al., Cancer Res. 2006 Nov. 15; 66(22): 10639-42; Ercolak et al., Breast Cancer Res Treat. 2008 May; 109(2):359-65; Matsushita et al., Leuk Lymphoma. 2003 March; 44(3):439-44; Mitsuhashi et al., Int. J Hematol. 2014; 100(1):88-95; Proto-Sequeire et al., Leuk Res. 2006 November; 30(11):1333-9; Szczepanski et al., Oral Oncol. 2013 February; 49(2): 144-51; Van Baren et al., Br J Haematol. 1998 September; 102(5): 1376-9). PRAME targeting therapies of the inventions may be particularly suitable for treatment of cancers including, but not limited to, acute myeloid leukemia, breast cancer, cholangiocellular carcinoma, gallbladder cancer, glioblastoma, hepatocellular carcinoma, head and neck squamous cell carcinoma, melanoma, amelanotic melanoma, non-Hodgkin lymphoma, non-small cell lung cancer adenocarcinoma, non-small cell lung cancer, squamous cell non-small cell lung cancer, ovarian cancer, esophageal cancer, renal cell carcinoma, small cell lung cancer, urinary bladder carcinoma, uterine and endometrial cancer, chronic lymphocytic leukemia, colorectal carcinoma, osteosarcoma and synovial sarcoma, preferably breast cancer, cholangiocellular carcinoma, hepatocellular carcinoma, head and neck squamous cell carcinoma, squamous cell non-small cell lung cancer, ovarian cancer, esophageal cancer, renal cell carcinoma, small cell lung cancer, urinary bladder carcinoma, uterine and endometrial cancer, and synovial sarcoma.

The "PRAME antigenic peptide" comprises or consists of the amino acid sequence SLLQHLIGL (SEQ ID NO: 50) which corresponds to amino acids 425-433 of the full length PRAME protein of the amino acid sequence of SEQ ID NO:

328 as accessible under the Uniprot accession number P78395 (as available on Jan. 11, 2019).). The PRAME derived peptide which comprises or consist of the amino acid sequence SLLQHLIGL (SEQ ID NO: 50) is also herein referred to as PRAME-004. The PRAME-004 peptide is a peptide epitope derived from a tumor-associated or tumor-specific protein and is presented on the cell surface by molecules of the major histocompatibility complex (MHC). More particularly, the PRAME-004 derived peptide is presented on the cell surface in complex with HLA-A*02. Med. 2001 Jan. 1; 193(1):73-88). In the context of the invention, the terms "PRAME antigenic peptide", "PRAME peptide" or "PRAME-004" are used interchangeably and refer to a peptide comprising or consisting of the amino acid sequence SLLQHLIGL (SEQ ID NO: 50). Preferably, the PRAME peptide consists of the amino acid sequence SLLQHLIGL. In instances where the PRAME peptide comprises further amino acids in addition to the amino acid sequence SLLQH-LIGL, it is preferred that the overall length of the PRAME peptide does not exceed 12 amino acids.

The term "antigen" or "target antigen" as used herein refers to a molecule or a portion of a molecule or complex that is capable of being bound by an antigen binding site, wherein said antigen binding site is, for example, present in an antibody, a TCR and/or other antigen binding protein of the present invention. The antigen in the context of the present invention is the PRAME peptide comprising or consisting of the amino acid sequence SLLQHLIGL of SEQ ID NO: 50, more particularly the PRAME peptide comprising or consisting of the amino acid sequence SLLQHLIGL of SEQ ID NO: 50 in a complex with a MHC protein, such as a HLA protein, for instance HLA-A*02.

A "domain" may be any region of a protein, generally defined on the basis of sequence homologies and often related to a specific structural or functional entity.

The term "immunoglobulin (Ig) domain" in the context of the present invention refers to a protein domain that consists of a 2-layer sandwich of 7-9 antiparallel β-strands arranged in two β-sheets with a Greek key topology. The Ig domain is probably the most frequently used "building block" in naturally occurring proteins. Proteins containing Ig domains are subsumed into the immunoglobulin superfamily, including e.g. antibodies, T-cell receptors (TCRs) and cell adhesion molecules. Examples of Ig domains are the variable and constant domains of antibodies and TCRs.

$V_\alpha$ in the context of the present invention refers to a variable domain of a TCR α-chain.

$V_\beta$ in the context of the present invention refers to a variable domain of a TCR β-chain.

$V_\gamma$ in the context of the present invention refers to a variable domain of a TCR γ-chain.

$V_\delta$ in the context of the present invention refers to a variable domain of a TCR δ-chain.

$V_A$ in the context of the present invention refers to a variable domain comprising TCR-derived CDRs, specifically an α-chain-derived CDR1a, CDR3a and optionally CDR2a. The sequences surrounding the CDRs, i.e. the framework sequences, may be derived from a variable domain of a TCR, i.e. a variable domain of a TCR α-chain, β-chain, γ-chain or δ-chain, or from a variable domain of an antibody, preferably from a variable domain of a TCR α-chain.

$V_B$ in the context of the present invention refers to a variable domain comprising TCR-derived CDRs, specifically β-chain-derived CDR1b, CDR3b and optionally CDR2b. The sequences surrounding the CDRs, i.e. the framework sequences, may be derived from a variable domain of a TCR, i.e. a variable domain of a TCR α-chain, β-chain, γ-chain or δ-chain, or from a variable domain of an antibody, preferably from a variable domain of a TCR β-chain.

$V_L$ in the context of the present invention refers to a variable domain of an antibody light chain.

$V_H$ in the context of the present invention refers to a variable domain of an antibody heavy chain.

$C_L$ in the context of the present invention refers to a constant domain of an antibody light chain.

$C_{H1}$, $C_{H2}$ and $C_{H3}$ in the context of the present invention refer to constant domains of an antibody heavy chain, in particular an IgG heavy chain.

The term "epitope", also known as antigenic determinant, is the part of an antigen that is recognized by the immune system. As used herein, the term epitope comprises the terms "structural epitope" and "functional epitope". The "structural epitope" are those amino acids of the antigen, e.g. peptide-MHC complex, that are covered by the antigen binding protein when bound to the antigen. Typically, all amino acids of the antigen are considered covered that are within 5 Å of any atom of an amino acid of the antigen binding protein. The structural epitope of an antigen may be determined by art known methods including X-ray crystallography or NMR analysis. The structural epitope of an antibody typically comprises 20 to 30 amino acids. The structural epitope of a TCR typically comprises 20 to 30 amino acids. The "functional epitope" is a subset of those amino acids forming the structural epitope and comprises the amino acids of the antigen that are critical for formation of the interface with the antigen binding protein of the invention or functional fragment thereof, either by directly forming non-covalent interactions such as H-bonds, salt bridges, aromatic stacking or hydrophobic interactions or by indirectly stabilizing the binding conformation of the antigen and is, for instance, determined by mutational scanning. In the context of the present invention, the functional epitope is also referred to as "binding motif". Typically, the functional epitope of an antigen bound by an antibody comprises between 4 and 6 amino acids. Typically, the functional epitope of a peptide-MHC complex comprises between 2 to 6 or 7 amino acids of the peptide and 2 to 7 amino acids of the MHC molecule. Since MHC I presented peptides typically have a length between 8 to 10 amino acids only a subset of amino acids of each given peptide is part of the functional epitope of a peptide-MHC complex. The epitope, in particular the functional epitope bound by the antigen binding proteins of the present invention comprises or consists of the amino acids of the antigen that are required for formation of the binding interface. In the context of the present invention, the functional epitope (i.e. the binding motif) comprises at least amino acids 3, 5 and 7, preferably not amino acids 1 and 4 of the PRAME-004 antigenic peptide of SEQ ID NO: 50.

The "Major Histocompatibility Complex" (MHC) is a set of cell surface proteins essential for the acquired immune system to recognize foreign molecules in vertebrates, which in turn determines histocompatibility. The main function of MHC molecules is to bind to antigens derived from pathogens and display them on the cell surface for recognition by the appropriate T cells. The human MHC is also called the HLA (human leukocyte antigen) complex (or just HLA). The MHC gene family is divided into three subgroups: class I, class II, and class III. Complexes of peptide and MHC class I are recognized by CD8-positive T cells bearing the appropriate T cell receptor (TCR), whereas complexes of peptide and MHC class II molecules are recognized by CD4– positive-helper-T cells bearing the appropriate TCR. Since both CD8 and CD4 dependent responses contribute jointly and synergistically to the anti-tumor effect, the identification and characterization of tumor-associated antigens and corresponding T cell receptors is important in the development of cancer immunotherapies such as vaccines and cell therapies. The HLA-A gene is located on the short arm of chromosome 6 and encodes the larger, α-chain, constituent of HLA-A. Variation of HLA-A α-chain is key to HLA function. This variation promotes genetic diversity in the population. Since each HLA has a different affinity for peptides of certain structures, greater variety of HLAs means greater variety of antigens to be 'presented' on the cell surface. The MHC class I HLA protein in the context of the present disclosure may be an HLA-A, HLA-B or HLA-C protein, suitably HLA-A protein, for example HLA-A*02. In the MHC class I dependent immune reaction, peptides not only have to be able to bind to certain MHC class I molecules expressed by tumor cells, they subsequently also have to be recognized by T cells bearing specific T cell receptors (TCR).

"Antigenic peptide in a complex with a MHC protein", herein refers to an antigenic peptide that is non-covalently bound to a MHC molecule. In particular, the antigenic peptide is located to a "peptide-binding groove" formed by the MHC molecule. A complex of an MHC molecule and an antigenic peptide is herein also referred to as "peptide-MHC complex" or "pMHC complex". In the case of the PRAME antigenic peptide, the complex is also referred to as "PRAME antigenic peptide-MHC complex" or "PRAME-004:MHC complex".

"HLA-A*02" signifies a specific HLA allele, wherein the letter A signifies the allele and the prefix "02 prefix" indicates the A2 serotype.

The term "Antigen Binding Protein" herein refers to a polypeptide comprising an antigen binding site that is able to specifically bind to an antigen. The antigen binding protein of the present invention comprises TCR-derived CDRs, in particular a variable domain $V_A$ comprising TCR-derived CDRa1, CDRa3, and optionally CDRa2, and a variable domain $V_B$ comprising TCR-derived CDRb1, CDRb3, and optionally CDRb2. In a particular embodiment, the entire $V_A$ domain and/or the entire $V_B$ domain are TCR-derived and are thus $V_\beta$ and $V_\beta$ or $V_\gamma$ and $V_\delta$ domains. In the context of the present specification, the term antigen binding protein includes multiple TCR and antibody formats as defined below. In an example, the antigen-binding protein comprises TCR-derived CDRs, in particular TCR-derived CDRa1, CDRa3, CDRb1, CDRb3 and optionally CDRa2 and CDRb2 as defined in the claims, which have been grafted onto antibody heavy and light chains. In another example, an entire TCR-derived $V_\alpha$ domain and/or an entire TCR-derived $V_\beta$ domain are grafted onto antibody heavy and light chains. The skilled person is aware that such constructs represent hybrid antigen binding proteins, which will have the antigen specificity of the TCR from which the CDRs or variable domains are derived but will have the overall structure of an antibody and may thus be referred to as "antibody". The term antigen binding protein further includes bispecific or multispecific antigen-binding proteins. In addition to the $V_A$ and $V_B$ comprising the TCR-derived CDRa1, CDRa3, CDRb1, CDRb3 and optionally CDRa2 and CDRb2 as defined in the claims, such bispecific or multispecific antigen-binding proteins further comprise at least one more variable domain and optionally a constant domain, wherein the variable and/or constant domains may be derived from an antibody or TCR. Again, the skilled person is aware that such constructs comprising elements of both antibodies and TCRs represent hybrid formats and may be referred to as "bispecific TCR", "bispecific antibody" or "bispecific TCR-antibody molecule", depending on the composition of the antigen-binding protein, but also on the perspective and/or focus of the skilled person. In some embodiments, the antigen binding protein of the present invention comprises the $V_A$ and $V_B$ comprising the TCR-derived CDRa1, CDRa3, CDRb1, CDRb3 and optionally CDRa2 and CDRb2 as defined in the claims, and further an additional domain fused directly or indirectly to $V_A$ or $V_B$. Such an antigen binding proteins can be referred to as "TCR fusion protein". Examples of additional domains comprised in a "TCR fusion protein" are listed below. In preferred embodiments, the antigen-binding proteins are bispecific TCR-antibody molecules as defined below, more preferably bispecific T cell engaging receptors (TCER®) as defined below. In such embodiments, the antigen-binding protein comprises two different antigen binding sites and is able to specifically bind to two different antigens simultaneously, as it is known from, for example bispecific antibodies.

In one embodiment, the antigen binding protein of the present disclosure specifically binds to a PRAME antigenic peptide that comprises or consists of the amino acid sequence SLLQHLIGL of SEQ ID NO: 50 and is in a complex with a major histocompatibility complex (MHC) protein, the antigen binding protein comprising (a) a first polypeptide comprising a variable domain $V_A$ comprising complementarity determining regions (CDRs) CDRa1, CDRa2 and CDRa3, wherein the CDRa1 comprises the amino acid sequence VKEFQD (SEQ ID NO: 16), or an amino acid sequence differing from SEQ ID NO: 16 by at most one, at most two, or at most three amino acid substitutions, and the CDRa3 comprises the amino acid sequence of ALYNNLDMR (SEQ ID NO: 33) or ALYNNYDMR (SEQ ID NO: 34), or an amino acid sequence differing from SEQ ID NO: 33 or SEQ ID NO: 34 by at most one, at most two, or at most three amino acid substitutions, and the CDRa2 comprises the amino acid sequence FGPYGKE (SEQ ID NO: 32), or an amino acid sequence differing from SEQ ID NO: 32 by at most one, at most two, or at least three amino acid substitutions, and (b) a second polypeptide comprising a variable domain $V_B$ comprising CDRb1, CDRb2 and CDRb3, wherein the CDRb1 comprises the amino acid sequence SGHNS (SEQ ID NO: 10) or an amino acid sequence differing from SEQ ID NO: 10 by at most one or at most two amino acid substitutions, and the CDRb3 comprises the amino acid sequence ASSX$_1$GX$_2$X$_3$DX$_4$QY (SEQ ID NO: 327), wherein X$_1$ is P, A or T, X$_2$ is A or S, X$_3$ is T or I, and X$_4$ is K or A, or an amino acid sequence differing from SEQ ID NO: 327 by at most one, at most two, or at most three amino acid substitutions, and the CDRb2 comprises the amino acid sequence FQNTAV (SEQ ID NO: 36) or a CDRb2 amino acid sequence differing from SEQ ID NO: 36 by at most one, at most two, at most three, at most four, at most five, or at most six amino acid substitutions.

In one embodiment, the antigen binding protein of the present disclosure comprises CDRa1 comprising SEQ ID NO: 16,
CDRa2 comprising SEQ ID NO: 32,
CDRa3 comprising SEQ ID NO: 33, CDRb1 comprising SEQ ID NO: 10,
CDRb2 comprising SEQ ID NO: 36, and
CDRb3 comprising SEQ ID NO: 327.

In one embodiment, the antigen binding protein of the present disclosure comprises
CDRa1 comprising SEQ ID NO: 16,
CDRa2 comprising SEQ ID NO: 32,
CDRa3 comprising SEQ ID NO: 34,
CDRb1 comprising SEQ ID NO: 10,
CDRb2 comprising SEQ ID NO: 36, and
CDRb3 comprising SEQ ID NO: 327.

In an embodiment, amino acid substitutions are conservative amino acid substitutions.

"At least one" herein refers to one or more of the specified objects such as 1, 2, 3, 4, 5 or 6 or more of the specified objects. For example, at least one binding site herein refers to 1, 2, 3, 4, 5 or 6 or more binding sites.

The term "bispecific" in the context of the present invention refers to antigen binding proteins with at least two valences and binding specificities for two different antigens and thus comprises at least two antigen binding sites. The term "valence" refers to the number of binding sites of an antigen binding protein, e.g. a bivalent antigen binding protein relates to an antigen binding protein that has two binding sites. The binding sites may bind to the same or different targets, i.e. a bivalent antigen binding protein may be monospecific, i.e. binding one target, or bispecific, i.e. binding two different targets. The antigen binding molecules of the present invention comprise at least one antigen-binding site comprising TCR-derived CDRs. In preferred embodiments, the antigen binding molecules of the present invention comprise at least one TCR-derived antigen-binding site.

The term "TCR" as used herein is meant to include conventional/native TCRs and engineered TCRs, in particular functional TCR fragments, single chain TCRs, and bispecific or multispecific TCRs.

"Native TCR" refers to a wildtype TCR that can be isolated from nature. A TCR that has the same type of domains and domain arrangements as a native TCR and comprises TCR-derived CDRs and framework regions may also be referred to as "conventional TCR". Native/conventional TCRs are heterodimeric cell surface proteins of the immunoglobulin super-family, which are associated with invariant proteins of the CD3 complex involved in mediating signal transduction. Native heterodimeric TCRs exist in $\alpha\beta$ and $\gamma\delta$ forms, which are structurally similar but have distinct locations and probably functions. The extracellular portion of native heterodimeric $\alpha\beta$ TCRs and $\gamma\delta$ TCRs contains two polypeptides, each of which has a membrane-proximal constant domain (also referred to as constant region), and a membrane-distal variable domain (also referred to as variable region). In the context of the present invention, such TCRs are also referred to as full-length TCRs. Native $\alpha\beta$ heterodimeric TCRs have an $\alpha$-chain and a $\beta$-chain. An $\alpha$-chain comprises variable (V), joining (J) and constant (C) regions, and a $\beta$-chain comprises V, J and C regions and usually further a short diversity (D) region between the variable and joining regions, although this diversity region is often considered as part of the joining region. The constant regions of TCR $\alpha$- and $\beta$-chains are referred to as TRAC and TRBC, respectively (Lefranc, (2001), Curr Protoc Immunol Appendix 1: Appendix 10). In the context of the present invention, the constant regions of TCR $\alpha$- and $\beta$-chains (TRAC and TRBC) include transmembrane (TM) regions. Each of the constant and variable regions (or domains) include an intra-chain disulfide bond.

The variable domains contain the highly polymorphic loops analogous to the complementarity determining regions (CDRs) of antibodies.

Each TCR variable domain comprises three "TCR complementarity determining regions" (CDRs) embedded in a framework sequence, one being the hypervariable region named CDR3. In the context of the present invention, CDRa1, CDRa2 and CDRa3 denote $\alpha$-chain CDRs, and CDRb1, CDRb2 and CDRb3 denote $\beta$-chain CDRs. There are several types of a chain variable domains and several types of $\beta$-chain variable domains distinguished by their framework, CDR1 and CDR2 sequences, and by a partly defined CDR3 sequence. The $\alpha$-chain variable domain types are referred to in IMGT nomenclature by a unique TRAV number, the $\beta$-chain variable domain types are referred to in IMGT nomenclature to by a unique TRBV number (Foich and Lefranc, (2000), Exp Can Immunogenet 17(1): 42-54; Scaviner and Lefranc, (2000), Exp Clin Immunogenet 17(2): 83-96; LeFranc and LeFranc, (2001), "T cell Receptor Factsbook", Academic Press). Further information on antibody and TCR genes can be found in the international ImMunoGeneTics information System®, Lefranc M-P et at, (Nucleic Acids Res. 2015 January; 43 (Database issue): D413-22; and http://www.imgt.org/). In TCRs, the CDR1 and CDR3 amino acid residues make contact with the antigenic peptide, while the CDR2 amino acid residues mainly contact the HLA molecule (Stadinski et al, J Immunol. 2014 Jun. 15; 192(12): 6071-6082; Cole et al., J Biol Chem. 2014 Jan. 10; 289(2):628-38). The antigen specificity of a TCR is thus defined by the CDR3 and CDR1 sequences. The CDR2 sequences are not required for the determination of antigen specificity, but may play a role in the overall affinity of a TCR towards a peptide:MHC complex.

"TCR framework regions" (FRs) refer to amino acid sequences interposed between the CDRs, i.e. to those portions of the variable domains that are to some extent conserved among different TCRs. The $\alpha$-, $\beta$-, $\gamma$- and $\delta$-chain variable domains each have four FRs, herein designated FR1-a, FR2-a, FR3-a, FR4-a (for an $\alpha$- or $\gamma$-chain), and FR1-b, FR2-b, FR3-b, FR4-b (for a $\beta$- or $\delta$-chain), respectively. Accordingly, an $\alpha$-chain or $\gamma$-chain variable domain may be described as (FR1-a)-(CDRa1)-(FR2-a)-(CDRa2)-(FR3-a)-(CDRa3)-(FR4-a) and a $\beta$- or $\delta$-chain variable domain may be described as (FR1-b)-(CDRb1)-(FR2-b)-(CDRb2)-(FR3-b)-(CDRb3)-(FR4-b). In the context of the present invention, the CDR/FR sequences in an $\alpha$-, $\beta$, $\gamma$- or $\delta$-chain variable domain is determined based on IMGT definition (Lefranc et al., Dev. Comp. Immunol., 2003, 27(1):55-77; www.imgt.org). Accordingly, CDR/FR amino acid positions when related to TCR or TCR-derived domains are indicated according to said IMGT definition. Preferably, the IMGT position of the CDR/FR amino acid positions of the variable domain $V_\alpha$ is given in analogy to the IMGT numbering of TRAV24*01 and/or the IMGT position of the CDR/FR amino acid positions of the variable domain $V_\beta$ is given in analogy to the IMGT numbering of TRBV12-3*01.

The term "$\alpha/\beta$ TCR/CD3 complex" refers in the context of the present invention to a T cell receptor complex as present on the surface of T cells. Most T cells express $\alpha/\beta$ TCRs, composed of disulfide bonded $\alpha$ and $\beta$ chains which typically bind composite surfaces of antigenic peptides presented by MHC. TCRs do not signal on their own but are constitutively associated with CD3, a protein complex which is designated as T cell co-receptor and contains intracellular signalling motifs (Birnbaum et al.; PNAS vol. 11, no. 49; 17576-17581, 2014). The $\alpha/\beta$ TCR is noncovalently coupled to this conserved multi-subunit signalling apparatus that comprises the CD3εγ, CD3εδ, and CD3ζζ; dimers, which collectively form the α/β TCR/CD3 complex.

"CD3" is a protein complex and is composed of four distinct chains. In mammals, the complex contains a CD3γ chain, a CD3δ chain, and two CD3ε chains. These chains associate with a TCR and the ζ-chain to generate an activation signal in T lymphocytes.

Engineered TCRs (and thus the term "TCR" as used in the context of the present invention) include functional TCR fragments, stability-maturated TCRs, affinity-maturated TCRs, single chain TCRs, chimeric, humanized, bispecific and multispecific TCRs, in particular. "Functional TCR fragment" includes (a) fragments of native or conventional TCRs that retain the ability of the TCR from which they are derived to bind to a target antigen, and (b) recombinant/ engineered antigen binding proteins comprising TCR-derived CDR sequences, in particular CDR1, CDR3 and optionally CDR2 sequences. As binding to the target antigen is defined by these CDR sequences, antigen binding proteins comprising them retain the ability of the TCR from which the CDRs are derived to bind to a target antigen. The skilled In the art is aware that the CDRs have to be interspersed with framework regions (FRs), however their specific amino acid sequences are not crucial for target antigen specificity. A variable domain comprising TCR-derived CDRs and antibody-derived FRs may thus be considered a "functional TCR fragment". Further examples of functional TCR fragments include single variable domains, such as $V_{\alpha}$, $V_{\beta}$, $V_{\delta}$, $V_{\gamma}$, or fragments of the α, β, δ, γ chain, such as "$V_{\alpha}$-$C_{\alpha}$" or "$V_{\beta}$-$C_{\beta}$" or portions thereof. Such fragments might also further comprise the corresponding hinge region. "Single chain TCR (scTCR)" as used herein denotes a TCR in which the variable domains of the TCR are located on a single polypeptide. Typically, the variable domains in scTCRs are separated by a linker, wherein said linker typically comprises 10 to 30 amino acids, such as 25 amino acids.

A "chimeric TCR" herein refers to a TCR, wherein the TCR chains comprise sequences from multiple species. Preferably, a TCR in the context of the invention may comprise an α-chain comprising a human variable region of an α-chain and, for example, a murine constant region of a murine TCR α-chain. "Bispecific TCRs" include bispecific TCR-antibody molecules, particularly scTCR-F$_{ab}$ or T cell engaging receptors (TCER®) as defined below.

The term "antibody" as used herein is meant to include conventional/native antibodies and engineered antibodies, in particular functional antibody fragments, single chain antibodies, single domain antibodies, bispecific or multispecific antibodies.

"Native antibody" refers to a wildtype antibody that can be isolated from nature. An antibody that has the same type of domains and domain arrangements as a native antibody and comprises antibody-derived CDR and FR sequences may also be referred to as "conventional antibody". In a native/conventional antibody, two heavy chains are linked to each other by disulfide bonds and each heavy chain is linked to a light chain by a disulfide bond. There are two types of light chain, lambda (λ) and kappa (κ). There are five main heavy chain classes (or isotypes) which determine the functional activity of an antibody molecule: IgM, IgD, IgG, IgA and IgE. Each chain contains distinct domains (also referred to as regions). The light chain includes two domains, a variable domain ($V_L$) and a constant domain ($C_L$). The heavy chain includes four or five domains depending on the antibody isotype; a variable domain ($V_H$) and three or four constant domains ($C_{H1}$, $C_{H2}$ and $C_{H3}$, and optionally $C_{H4}$, collectively referred to as $C_H$). The variable domains of both light ($V_L$) and heavy ($V_H$) chains determine binding recognition and specificity to the antigen. The constant domains of the light ($C_L$) and heavy ($C_H$) chains confer important biological properties such as antibody chain association, secretion, trans-placental mobility, complement binding, and binding to F$_c$ receptors (F$_c$R).

The specificity of the antibody resides in the structural complementarity between the antibody binding site and the antigenic determinant. Antibody binding sites are made up of residues that are primarily from the "antibody complementarity determining regions" (CDRs) or hypervariable regions. Occasionally, residues from non-hypervariable or framework regions (FR) influence the overall domain structure and hence the binding site. CDRs refer to amino acid sequences that together define the binding affinity and specificity of the natural Fv region of a native antibody binding site. The light and heavy chains of an antibody each have three CDRs, designated CDR1-L, CDR2-L, CDR3-L and CDR1-H, CDR2-H, CDR3-H, respectively. An antibody antigen-binding site, therefore, includes six CDRs, comprising the CDR set from each of a heavy and a light chain V region. "Antibody framework regions" (FRs) refer to amino acid sequences interposed between CDRs, i.e. to those portions of antibody light and heavy chain variable regions that are relatively conserved among different antibodies in a single species. The light and heavy chains of an antibody each have four FRs, designated FR1-L, FR2-L, FR3-L, FR4-L, and FR1-H, FR2-H, FR3-H, FR4-H, respectively. Accordingly, the light chain variable domain may be described as (FR1-L)-(CDR1-L)-(FR2-L)-(CDR2-L)-(FR3-L)-(CDR3-L)-(FR4-L) and the heavy chain variable domain may be described as (FR1-H)-(CDR1-H)-(FR2-H)-(CDR2-H)-(FR3-H)-(CDR3-H)-(FR4-H). As used herein, a "human framework region" is a framework region that is substantially identical (about 85%, or more, in particular 90%, 95%, 97%, 99% or 100%) to the framework region of a naturally occurring human antibody. In the context of the invention, CDR/FR definition in an antibody light or heavy chain variable domain is determined based on IMGT definition (Lefranc et al., Dev. Comp. Immunol., 2003, 27(1):55-77; www.imgt.org). Accordingly, amino acid sequences of the CDR1, CDR2 and CDR3 of a given variable chain and the amino acid sequences of FR1, FR2, FR3 and FR4 are indicated according to said IMGT definition.

Engineered antibody formats include functional antibody fragments, single chain antibodies, single domain antibodies, and chimeric, humanized, bispecific or multispecific antibodies. Engineered antibody formats further include constructs in which TCR-derived CDRs, possibly including additional 3, 2 or 1 N and/or C terminal framework residues, or entire TCR-derived variable domains are grafted onto antibody heavy or light chains. More particularly, CDRa1, CDRa3 and optionally CDRa2 may be grafted into the variable heavy chain amino acid sequence and CDRb1, CDRb3 and optionally CDRb2 may be grafted into the variable light chain amino acid sequence, or vice versa. As another example, the light chain variable domain of an antibody may be replaced with the α-chain variable domain of a TCR and the heavy chain variable domain may be replaced with the β-chain variable domain of a TCR, or vice versa. A "functional antibody fragment" refers to a portion of a full-length antibody that retains the ability to bind to its target antigen, in particular the antigen binding region or variable region of the full-length antibody. Examples of functional antibody fragments include Fv, Fab, F(ab')2, Fab', dsFv, (dsFv)2, scFv, sc(Fv)2 and diabodies. A functional antibody fragment may also be a single domain antibody, such as a heavy chain antibody. The term "Fab" denotes an antibody fragment having a molecular weight of about 50,000 Dalton and antigen binding activity, in which about a half of the N-terminal side of H chain and the entire L chain, among fragments obtained by treating IgG with a protease, e.g. papain, are bound together through a disulfide bond. The Fv fragment is the N-terminal part of the Fab fragment of an antibody and consists of the variable portions of one light chain and one heavy chain.

As used herein, a "format" of an antigen binding protein specifies a defined spatial arrangement of domains, in particular of variable and optionally constant domains. Important characteristics of such antigen binding protein formats are the number of polypeptide chains (single chain, double chain or multiple chains), the type and length of linkers connecting different domains, the number of variable domains (and thus the number of valences), the number of different variable domains (and thus the number of specificities for different antigens, e.g. bispecific, multispecific), and the order and orientation of variable domains (e.g. cross-over, parallel).

Many different bispecific and multispecific formats are described in the art in the context of antibodies and, as it will be understood by the sidled in the art, such bispecific and multispecific formats can be used in context of the present invention by replacing in these formats antibody domains with the variable domains described in context of the present invention. Such formats include e.g. diabodies, cross-over dual variable domain (CODV) and dual variable domain (DVD) proteins. An overview of different bispecific antibody formats and ways of producing them are disclosed in, for example, Brinkmann U, and Kontermann E. E. MAbs. 2017 February-March; 9(2): 182-212. The DVD format is, for example, disclosed in the following scientific articles (Wu C et al. Nat Biotechnol 2007; 25:1290.7; PMID: 17934452; Wu C. et al. MAbs 2009; 1:339-47; Lacy S E et al. MAbs 2015; 7:605-19; PMID:25764208; Craig R B et al. PLoS One 2012; 7:e46778; PMID:23056448; Piccione E C et al. MAbs 2015). The CODV is for example disclosed in Onuoha S C et al. Arthritis Rheumatol. 2015 October; 67(10):2661-72 or for example in WO2012/135345, WO2016/116626. Diabodies are for example described in Holliger P et al. Protein Eng 1996; 9:299-305; PMID: 8736497; Atwell J L et al. Mol Immunol 1996; 33:1301-12; PMID:9171890; Kontermann R E, Nat Biotechnol 1997; 15:629-31; PMID:9219263; Kontermann R E et al. Immunotechnology 1997; 3:137-44; PMID:9237098; Cochbvius B et al. Cancer Res 2000; 60:4336-41; PMID:10969772; and DeNardo D G et al. Cancer Biother Radiopharm 2001; 16:525-35; PMID:11789029.

"Diabody" refers to a bivalent molecule composed of two chains, each comprising two variable domains, either from the same or from different antibodies. If the antibodies are different, typically the variable domains of one antibody (antibody X comprising $V_{LX}$ and $V_{HX}$) are located on two different polypeptide chains and the variable domains of the other antibody (antibody Y comprising $V_{LY}$ and $V_{HY}$) are also located on two different polypeptide chains. The domains dimerize in a head-to-tail orientation. The two chains may have the configuration $V_{HX}$-$L_{Db1}$-$V_{LY}$ and $V_{HY}$-$L_{Db2}$-$V_{LX}$ or $V_{LX}$-$L_{Db1}$-$V_{HY}$ and $V_{LY}$-$L_{Db2}$-$V_{HX}$ or $V_{HX}$-$L_{Db1}$-$V_{HY}$ and $V_{LY}$-$L_{Db2}$-$V_{LX}$ or $V_{LX}$-$L_{Db1}$-$V_{LY}$ and $V_{HY}$-$L_{Db2}$-$V_{HX}$. In order to allow the domains to dimerize head to-tail, the two chains comprise linker, i.e. $L_{Db1}$ and $L_{Db2}$, which separate the variable domains and can be identical or different. The linkers are preferably short linkers. A short linker is typically between 2 to 12, 3 to 13, such as 3, 4, 5, 6, 7, 8, 9 amino acids long, for example 4, 5 (Brinkmann U. and Kontermann E. E. (MAbs. 2017 February-March; 9(2): 182-212) or 8 amino acids long, such as 'GGGS' of SEQ ID NO: 290, 'GGGGS' of SEQ ID NO: 286 or 'GGGSGGGG' of SEQ ID NO: 214.

In the "dual variable domain immunoglobulin" (DVD-Ig™)" format, the target-binding variable domains of a monoclonal antibody Y (domains $V_{LY}$ and $V_{HY}$) are typically fused to a conventional antibody X (comprising the domains $V_{LX}$ and $V_{HX}$), wherein the light chain of the conventional antibody X thus comprises an additional light chain variable domain ($V_{LY}$) and the heavy chain of the conventional antibody X comprises an additional heavy chain variable domain ($V_{HY}$). The DVD-Ig™ as described in the art is typically composed of two polypeptide chains, one heavy chain comprising $V_{HY}$-$L_1$-$V_{HX}$-$L_2$-$C_{H1}$-$C_{H2}$-$C_{H3}$ and one light chain comprising $V_{LY}$-$L_3$-$V_{LX}$-$L_4$-CL or one heavy chain comprising $V_{HX}$-$L_1$-$V_{HY}$-$L_2$-$C_{H1}$-$C_{H2}$-$C_{H3}$ and one light chain comprising $V_{LX}$-$L_3$-$V_{LY}$-$L_4$-$C_L$. The domains $V_{HY}$/$V_{LY}$ and $V_{HX}$/$V_{LX}$ are thus, pairing in parallel. The connecting linkers $L_1$ and $L_3$ are preferably between 5 to 20 amino acids, such as 5 to 15 amino acids, and/or the connecting linkers $L_2$ and $L_4$ may be present or absent.

The "crossover dual variable domain" (CODV) format as described in the art represents a format in which the variable domains of an antibody X ($V_{LX}$ and $V_{HX}$) are linked to the variable domains of an antibody Y ($V_{LY}$ and $V_{HY}$) in a way that allows crossover pairing of the variable domains.

In the CODV-Ig format in the context of the present invention the polypeptide chains have, for example, the configuration $V_{HX}$-$L_1$-$V_{HY}$-$L_2$-$C_{H1}$-$C_{H2}$-$C_{H3}$ and $V_{LY}$-$L_3$-$V_{LX}$-$L_4$-$C_L$, or $V_{HY}$-$L_1$-$V_{HX}$-$L_2$-$C_{H1}$-$C_{H2}$-$C_{H3}$ and $V_{LX}$-$L_3$-$V_{LY}$-$L_4$-$C_L$ or $V_{HX}$-$L_3$-$V_{HY}$-$L_4$-$C_{H1}$-$C_{H2}$-$C_{H3}$ and $V_{LY}$-$L_1$-$V_{LX}$-$L_2$-$C_L$ or $V_{HY}$-$L_3$-$V_{HX}$-$L_4$-$C_{H1}$-$C_{H2}$-$C_{H3}$ and $V_{LX}$-$L_1$-$V_{LY}$-$L_2$-$C_L$. The connecting linkers ($L_1$ to $L_4$), which may also be all-glycine linkers or serine-glycine linkers, are typically of different length. In order to allow for the crossover pairing, one chain (heavy or light chain) typically comprises longer linkers than the other chain. For example, in the CODV configurations listed above, $L_1$ is 3 to 12 amino acid residues in length, $L_2$ is 3 to 14 amino acid residues in length, $L_3$ is 1 to 8 amino acid residues in length, and $L_4$ is 1 to 3 amino acid residues in length, or $L_1$ is 5 to 10 amino acid residues in length, 1.2 is 5 to 8 amino acid residues in length, $L_3$ is 1 to 5 amino acid residues in length, and $L_4$ is 1 to 2 amino acid residues in length or $L_1$ is 7 amino acid residues in length, $L_2$ is 5 amino acid residues In length, $L_3$ is 1 amino acid residues in length, and La is 2 amino acid residues in length.

The term "humanized antibody" refers to an antibody which is completely or partially of non-human origin and which has been modified by replacing certain amino acids, in particular in the framework regions of the heavy and light chains, in order to avoid or minimize an immune response in humans. The constant domains of a humanized antibody are mainly human $C_H$ and $C_L$ domains. Numerous methods for humanization of an antibody sequence are known in the art; see e.g. the review by Almagro & Fransson (2008) Front Biosci. 13: 1619-1633.

As it will be understood by the person skilled in the art, the structures of antibodies, in particular the structure of the heavy and light chain variable domains of antibodies is analogous to the structure of the TCR α-, β-, γ- or δ-chain variable domains, facilitating the grafting of the CDRs as defined in the context of the present invention into antibodies, including conventional antibodies, bispecific antibodies, or multispecific antibodies.

Knowing the amino acid sequence of the CDRs of an antibody, a TCR or an antigen binding protein of the invention, one skilled in the art can easily determine the framework regions, such as the TCR framework regions or antibody framework regions. In cases where the CDRs are not indicated, the skilled in the art can first determine the CDR amino acid sequences based on the IMGT definition for TCRs or the IMGT definition for antibodies and then determine the amino acid sequences of the framework regions.

Bispecific TCR-Antibody Formats

In preferred embodiments, the antigen binding proteins of the present invention are bispecific molecules, in particular bispecific TCR-antibody molecules, i.e. antigen binding proteins which comprise at least two antigen binding sites, wherein one is derived from an antibody and the other is derived from a TCR or at least comprises TCR-derived CDRs, in particular CDR1a, CDR3a, CDR1b, CDR3b and optionally CDR2a and CDR2b. The antigen binding site derived from an antibody comprises the variable domains $V_L$ and $V_H$.

In such bispecific TCR-antibody molecules, the variable domains may be arranged e.g. as described for the different bispecific antibody formats discussed above. Techniques to produce such bispecific antibodies are also disclosed in the above cited prior art and the skilled in the art can thus easily use the CDRs or the variable domains as herein defined to generate and produce the antigen binding proteins of the invention in the herein disclosed formats. In addition, further formats are possible, e.g. formats in which on each chain, the variable domains are separated by a constant domain that mediates dimerization, such that in the final molecule the two antigen binding sites are located on two sides of the dimerized constant domains. The skilled person is entirely capable of selecting suitable linkers to ensure folding in the desired conformation.

In most preferred embodiments, the antigen binding proteins of the present invention are bispecific T cell engaging receptors (TCER®) which are soluble $F_c$-containing bispecific antigen binding molecules comprising a TCR antigen binding site and an antibody antigen binding site. The antibody antigen binding site is formed by the heavy and light chain variable domains of an antibody and is also referred to as "recruiter", as it binds an effector cell, e.g. a T cell, and recruits it to a tumor. TCER® comprise two polypeptide chains, wherein the antigen binding sites are formed by variable domains located on different polypeptide chains in a cross-over orientation.

In the context of the present application, a sequence that is "at least 85% identical to a reference sequence" is a sequence having, over its entire length, 85%, or more, in particular 90%, 91%, 92%, 93%, 94%, 95%, 96%, 97%, 98% or 99% sequence identity with the entire length of a reference sequence. Proteins consisting of an amino acid sequence "At least 80%. 85%, 90%, 95%, 96%, 97%, 98% or 99% Identical" to a reference sequence may comprise mutations such as deletions, insertions and/or substitutions compared to the reference sequence. In case of substitutions, the protein consisting of an amino acid sequence at least 80%, 85%, 90%, 95%, 96%, 97%, 98% or 99% identical to a reference sequence may correspond to a homologous sequence derived from another species than the reference sequence.

In the context of the present application, the "percentage of identity" can be calculated using a global pairwise alignment (i.e. the two sequences are compared over their entire length). Methods for comparing the identity of two or more sequences are well known in the art. For example, the "needle" program, which uses the Needleman-Wunsch global alignment algorithm (Needleman and Wunsch, 1970 J. Mol. Biol. 48:443-453) to find the optimum alignment (including gaps) of two sequences when considering their entire length, may be used. The needle program is for example available on the ebi.ac.uk World Wide Web site and is further described in the following publication (EMBOSS: The European Molecular Biology Open Software Suite (2000) Rice, P. Longden, I, and Bleasby, A. Trends in Genetics 16, (6) pp. 276-277). The percentage of identity between two polypeptides, in accordance with the invention, is calculated using the EMBOSS: needle (global) program with a "Gap Open" parameter equal to 10.0, a "Gap Extend" parameter equal to 0.5, and a Blosum62 matrix.

"Amino add substitutions" may be conservative or non-conservative. Preferably, substitutions are conservative substitutions, in which one amino acid is substituted for another amino acid with similar structural and/or chemical properties.

In an embodiment, conservative substitutions may include those, which are described by Dayhoff in "The Atlas of Protein Sequence and Structure. Vol. 5", Natl. Biomedical Research, the contents of which are incorporated by reference in their entirety. For example, in an aspect, amino acids, which belong to one of the following groups, can be exchanged for one another, thus, constituting a conservative exchange: Group 1: alanine (A), proline (P), glycine (G), asparagine (N), serine (S), threonine (T); Group 2: cysteine (C), serine (S), tyrosine (Y), threonine (T); Group 3: vane (V), isoleucine (I), leucine (L), methionine (M), alanine (A), phenylalanine (F); Group 4: lysine (K), arginine (R), histidine (H); Group 5: phenylalanine (F), tyrosine (Y), tryptophan (W), histidine (H); and Group 6: aspartic acid (D), glutamic acid (E). In an aspect, a conservative amino acid substitution may be selected from the following of T→A, G→A, A→I, T→V, A→M, T→I, A→V, T→G, and/or T→S.

In a further embodiment, a conservative amino acid substitution may include the substitution of an amino acid by another amino acid of the same class, for example, (1) nonpolar: Ala, Val, Leu, Ile, Pro, Met, Phe, Trp; (2) uncharged polar: Gly, Ser, Thr, Cys, Tyr, Asn. Gin; (3) acidic: Asp. Glu; and (4) basic: Lys. Arg. His. Other conservative amino acid substitutions may also be made as follows: (1) aromatic: Phe, Tyr. His; (2) proton donor: Asn, Gin, Lys, Arg, His, Trp; and (3) proton acceptor: Glu, Asp, Thr, Ser, Tyr, Asn, Gln (see, for example, U.S. Pat. No. 10,106,805, the contents of which are incorporated by reference in their entirety).

In another embodiment, conservative substitutions may be made in accordance with Table 1. Methods for predicting tolerance to protein modification may be found in, for example, Guo et al, Proc. Natl. Acad. Sci., USA. 101(25): 9205-9210 (2004), the contents of which are incorporated by reference in their entirety.

TABLE 1

| Conservative Amino Acid substitutions | |
|---|---|
| Conservative Amino Acid Substitutions | |
| Amino Acid | Substitutions (others are known in the art) |
| Ala | Ser, Gly, Cys |
| Arg | Lys, Gln, His |
| Asn | Gln, His, Glu, Asp |
| Asp | Glu, Asn, Gln |
| Cys | Ser, Met, Thr |

TABLE 1-continued

| Conservative Amino Acid substitutions Conservative Amino Acid Substitutions | |
| --- | --- |
| Amino Acid | Substitutions (others are known in the art) |
| Gln | Asn, Lys, Glu, Asp, Arg |
| Glu | Asp, Asn, Gln |
| Gly | Pro, Ala, Ser |
| His | Asn, Gln, Lys |
| Ile | Leu, Val, Met, Ala |
| Leu | Ile, Val, Met, Ala |
| Lys | Arg, Gln, His |
| Met | Leu, Ile, Val, Ala, Phe |
| Phe | Met, Leu, Tyr, Trp, His |
| Ser | Thr, Cys, Ala |
| Thr | Ser, Val, Ala |
| Trp | Tyr, Phe |
| Tyr | Trp, Phe, His |
| Val | Ile, Leu, Met, Ala, Thr |

In another embodiment, conservative substitutions may be those shown in Table 2 under the heading of "conservative substitutions." If such substitutions result in a change in biological activity, then more substantial changes, denominated "exemplary substitutions" in Table 2, may be introduced and the products screened if needed.

TABLE 2

| Amino Acid substitutions Amino Acid Substitutions | | |
| --- | --- | --- |
| Original Residue (naturally occurring amino acid) | Conservative Substitutions | Exemplary Substitutions |
| Ala (A) | Val | Val; Leu; Ile |
| Arg (R) | Lys | Lys; Gln; Asn |
| Asn (N) | Gln | Gln; His; Asp, Lys; Arg |
| Asp (D) | Glu | Glu; Asn |
| Cys (C) | Ser | Ser; Ala |
| Gln (Q) | Asn | Asn; Glu |
| Glu (E) | Asp | Asp; Gln |
| Gly (G) | Ala | Ala |
| His (H) | Arg | Asn; Gln; Lys; Arg |
| Ile (I) | Leu | Leu; Val; Met; Ala; Phe; Norleucine |
| Leu (L) | Ile | Norleucine; Ile; Val; Met; Ala; Phe |
| Lys (K) | Arg | Arg; Gln; Asn |
| Met (M) | Leu | Leu; Phe; Ile |
| Phe (F) | Tyr | Leu; Val; Ile; Ala; Tyr |
| Pro (P) | Ala | Ala |
| Ser (S) | Thr | Thr |
| Thr (T) | Ser | Ser |
| Trp (W) | Tyr | Tyr; Phe |
| Tyr (Y) | Phe | Trp; Phe; Thr; Ser |
| Val (V) | Leu | Ile; Leu; Met; Phe; Ala; Norleucine |

The antigen binding proteins of the present invention can be of any length, i.e., can comprise any number of amino acids, provided that they retain their biological activity, e.g., the ability to specifically bind to their target antigen, detect diseased cells in a host, or treat or prevent disease in a host, etc.

The antigen binding proteins of the present invention can comprise synthetic amino adds in place of one or more naturally-occurring amino acids. Such synthetic amino acids are known in the art, and may include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, ornithine, α-aminocyclopentane carboxylic acid, α-aminocyclohexane carboxylic acid, α-aminocycloheptane carboxylic acid, α-(2-amino-2-norbornane)-carboxylic acid, α,γ-diaminobutyric acid, α,β-diaminopropionic acid, homophenylalanine, and α-tert-butylglycine.

In one embodiment, the antigen binding protein of the present invention can be glycosylated, amidated, carboxylated, phosphorylated, esterified, N-acylated, cyclized via, e.g., a disulfide bridge, or converted into an acid addition salt and/or optionally dimerized or polymerized, or conjugated.

In a further embodiment, the antigen binding protein of the invention is in the form of a salt, for example, a pharmaceutically acceptable salt. Suitable pharmaceutically acceptable acid addition salts may include those derived from mineral acids, such as hydrochloric, hydrobromic, phosphoric, metaphosphoric, nitric, and sulphuric acids, and organic acids, such as tartaric, acetic, citric, malic, lactic, fumaric, benzoic, glycolic, gluconic, succinic, and arylsulphonic acids, for example, p-toluenesulphonic acid.

A "covalent link" herein refers for example to a disulfide bridge or a peptide link or a covalent link via a linker or a linker sequence, such as a polypeptide linker.

The term linker as used herein refers to one or more amino acid residues inserted between domains or a domain and an agent to provide sufficient mobility for the domains or elements, for example the variable domains of the antigen binding proteins of the invention to fold correctly to form the antigen binding sites, e.g. in a cross over pairing (in a CODV format or in some of the diabody formats) or in a parallel pairing configuration (for example in a DVD format) of the antigen binding proteins.

In some embodiments, a linker consists of 0 amino acid meaning that the linker is absent. A linker is inserted at the transition between variable domains or between variable domains and constant domains (or dimerization domains), respectively, at the amino acid sequence level. The transition between domains can be identified because the approximate size of the antibody domains as well as of the TCR domains is well understood. The precise location of a domain transition can be determined by locating peptide stretches that do not form secondary structural elements such as beta-sheets or alpha-helices as demonstrated by experimental data or as can be assumed by techniques of modeling or secondary structure prediction. The term linker used in the context of the present invention includes but is not limited to the linkers referred to as $L_1$, $L_2$, $L_3$, $L_4$, $L_5$ and $L_6$.

A linker, as long as it is not specified otherwise in the respective context, such as $L_1$, $L_2$, $L_3$, $L_4$, $L_5$ and $L_6$, can be from at least 1 to 30 amino acids in length. In some embodiments, a linker, such as $L_1$, $L_2$, $L_3$, $L_4$, $L_5$ and $L_6$, can be 2-25, 2-20, or 3-18 amino acids long. In some embodiments, a linker, such as $L_1$, $L_2$, $L_3$, $L_4$, $L_5$ and $L_6$, can be a peptide of a length of no more than 14, 13, 12, 11, 10, 9, 8, 7, 6, or 5 amino acids. In other embodiments, a linker, such as $L_1$, $L_2$, $L_3$, $L_4$, $L_5$ and $L_6$, can be 5-25, 5-15, 4-11, 10-20, or 20-30 amino acids long. In other embodiments, a linker, such as $L_1$, $L_2$, $L_3$, $L_4$, $L_5$ and $L_6$, can be about, 2, 3, 4, 5, 6, 7, 8, 9, 10, 11, 12, 13, 14, 15, 16, 17, 18, 19, 20, 21, 22, 23, 24, 25, 26, 27, 28, 29, or 30 amino adds long. In a particular embodiment, a linker, such as $L_1$, $L_2$, $L_3$. $L_4$, $L_5$ and $L_6$, can be less than 24, less than 20, less than 16, is less than 12, less than 10, for example from 5 to 24, 10 to 24 or 5-10 amino acid residues in length. In some embodiments, said linker is equal to 1 or more amino acid residues in length, such as more than 1, more than 2, more than 5, more than 10, more than 20 amino acid residues in length, more than 22 amino acid residues in length.

Exemplary linkers, such as $L_1$, $L_2$, $L_3$, $L_4$, $L_5$ and $L_6$, comprise or consist of an amino acid sequence selected from the group consisting of GGGS (SEQ ID NO: 290), GGGGS (SEQ ID NO: 286), GGGAS (SEQ ID NO: 287), GGGSGGGG (SEQ ID NO: 214), GGGGSGGGGSGGGGSGGGGSGGGGS (SEQ ID NO: 61), GGGGSGGGGSGGGGSGGGGS (SEQ ID NO: 70), GGSGG (SEQ ID NO: 226), GGGGSGGGGSGGGGS (SEQ ID NO: 280) GGGGSAAA (SEQ ID NO: 358), in particular GGGSGGGG (SEQ ID NO: 214), GGGGSGGGGSGGGGSGGGGS (SEQ ID NO: 70) and GGGGSGGGGSGGGGSGGGGSGGGGS (SEQ ID NO: 61).

The term "$F_c$ domain" as used in the context of the present invention encompasses native $F_c$ and $F_c$ variants and includes both monomeric dimeric, and multimeric $F_c$ domains, whether digested from whole antibody or produced by other means.

The term "native $F_c$" as used herein refers to a molecule comprising the sequence of a non-antigen-binding fragment resulting from digestion of an antibody or produced by other means, whether in monomeric, dimeric, or multimeric form, and can contain the hinge region. The original antibody source of the native $F_c$ is, in particular, of human origin and can be any of the antibody classes, although IgG1 and IgG2 are preferred. Native $F_c$ molecules are made up of monomeric polypeptides that can be linked into dimeric or multimeric forms by covalent (i.e., disulfide bonds) and non-covalent association. The number of intermolecular disulfide bonds between monomeric subunits of native $F_c$ molecules ranges from 1 to 4 depending on class (e.g., IgG, IgA, and IgE) or subclass (e.g., IgG1, IgG2, IgG3, IgAl, and IgGA2). One example of a native $F_c$ is a disulfide-bonded dimer resulting from papain digestion of an IgG. One example of a native $F_c$ amino acid sequence is SEQ ID NO: 329.

The term "$F_c$ variant" as used herein refers to a molecule or sequence that is modified from a native $F_c$ but still comprises a binding site for the salvage receptor, $F_c$Rn (neonatal $F_c$ receptor). Exemplary F, variants, and their interaction with the salvage receptor, are known in the art. Thus, the term "$F_c$ variant" can comprise a molecule or sequence that is humanized from a non-human native $F_c$. Furthermore, a native $F_c$ comprises regions that can be removed because they provide structural features or biological activity that are not required for the antigen binding proteins of the invention. Thus, the term "$F_c$ variant" comprises a molecule or sequence that lacks one or more native $F_c$ sites or residues, or in which one or more $F_c$ sites or residues has be modified, that affect or are involved in: (1) disulfide bond formation, (2) incompatibility with a selected host cell, (3) N-terminal heterogeneity upon expression in a selected host cell, (4) glycosylation, (5) interaction with complement, (6) binding to an $F_c$ receptor other than a salvage receptor, or (7) antibody-dependent cellular cytotoxicity (ADCC).

In one embodiment, the Fc-domain is a human IgG Fc domain, preferably derived from human IgG1, IgG2, IgG3 or IgG4, preferably IgG1 or IgG2, more preferably IgG1.

In some embodiments, when the antigen binding protein contains two $F_c$ domains ($F_{c1}$ and $F_{c2}$), e.g. in the TCER® format used in the examples, the two $F_c$ domains are of the same antibody isotype or isotype subclass. Accordingly, in some embodiments both $F_{c1}$ and $F_{c2}$ are of the 1901 subclass, or of the IgG2 subclass, or of the IgG3 subclass, or of the IgG4 subclass.

In a preferred embodiment, both $F_{c1}$ and $F_{c2}$ are of the 101 subclass, or of the IgG2 subclass, more preferably of the IgG1 subclass.

In some embodiments, the $F_c$ regions further comprise the RF and/or "knob-into-hole" mutation as defined herein below.

The "RF mutation" generally refers to the mutation of the amino acids HY into RF in the CH3 domain of $F_c$ domains, such as the mutation H435R and Y436F in CH3 domain as described by Jendeberg, L. et al., (1997, J. Immunological Meth., 201: 25-34) and is described as advantageous for purification purposes as it abolishes binding to protein A. In case the antigen binding protein comprises two $F_c$-domains, the RF mutation may be in one or both, preferably in one $F_c$-domain.

The "knob-into-hole" technology refers to mutations T366S, L368A and Y407V, in particular T366S, (hole) and 1366W (knob) both in the $C_{H3}$-$C_{H3}$ interface to promote heteromultimer formation has been described in U.S. Pat. Nos. 5,731,168 and 8,216,805, notably, which are herein incorporated by reference. Those knob-into-hole mutations can be further stabilized by the introduction of additional cysteine amino acid substitutions Y349C and S354C.

The "knob" mutation is, for example, present in the $F_c$ amino acid sequence of SEQ ID NO: 149 and the "hole" mutation is, for example, present in the $F_c$ amino acid sequence of SEQ ID NO: 150.

In some embodiments, the $F_c$ domain of one of the polypeptides, for example $F_{c1}$, comprises the amino acid substitution T366W (knob) in its Cm domain and the $F_c$ domain of the other polypeptide, for example $F_{c2}$, comprises the amino acid substitution T366S, L368A and Y407V (hole) in its $C_{H3}$ domain, or vice versa.

In some embodiments, the $F_c$ domain of one of the polypeptides, for example $F_{c1}$, comprises or further comprises the amino acid substitution S354C in its $C_{H3}$ domain and the $F_c$ domain of the other polypeptide, for example $F_{c2}$, comprises or further comprises the amino acid substitution Y349C in its $C_{H3}$ domain, or vice versa.

Accordingly, in some embodiments, the $F_c$ domain of one of the polypeptides, for example $F_{c1}$, comprises the amino acid substitutions S354C and T366W (knob) in its $C_{H3}$ domain and the $F_c$ domain of the other polypeptide, for example $F_{c2}$, comprises the amino acid substitution Y349C, 13668, L368A and Y407V (hole) in its $C_{H3}$ domain, or vice versa.

This set of amino acid substitutions can be further extended by inclusion of the amino acid substitutions K409A on one polypeptide and F405K in the other polypeptide as described by Wei et al. (Structural basis of a novel heterodimeric $F_c$ for bispecific antibody production, Onco-target. 2017). Accordingly, in some embodiments, the $F_c$ domain of one of the polypeptides, for example F61, comprises or further comprises the amino acid substitution K409A in its $C_{H3}$ domain and the $F_6$ domain of the other polypeptide, for example Fa, comprises or further the amino acid substitution F405K in its $C_{H3}$ domain, or vice versa.

In some cases, artificially introduced cysteine bridges may improve the stability of the antigen binding proteins, optimally without interfering with the binding characteristics of the antigen binding proteins. Such cysteine bridges can further improve heterodimerization.

Further amino acid substitutions, such as charged pair substitutions, have been described in the art, for example in EP 2 970 484 to improve the heterodimerization of the resulting proteins.

Accordingly, in one embodiment, the $F_c$ domain of one of the polypeptides, for example $F_{c1}$, comprises or further comprises the charge pair substitutions E356K, E356R, D356R, or D356K and D399K or D399R, and the $F_c$ domain of the other polypeptide, for example Fa, comprises or further comprises the charge pair substitutions R409D, R409E, K409E, or K409D and N392D, N392E, K392E, or K392D, or vice versa.

In a further embodiment, the $F_c$ domain on one or both, preferably both polypeptide chains can comprise one or more alterations that inhibit $F_c$ gamma receptor ($F_c\gamma$R) binding. Such alterations can include L234A, L235A.

In a further embodiment, the $F_c$ domain on one or both, preferably both polypeptide chains can comprise a N2970 mutation to remove the N-glycosylation site within the $F_c$-part, such a mutation abrogates the $F_c$-gamma-receptor interaction.

The "hinge", "hinge region" or "hinge domain" refers typically to the flexible portion of a heavy chain located between the $C_{H1}$ domain and the $C_{H2}$ domain. It is approximately 25 amino acids long, and is divided into an "upper hinge," a "middle hinge" or "core hinge," and a "lower hinge." A "hinge subdomain" refers to the upper hinge, middle (or core) hinge or the lower hinge. The amino acids sequences of the hinges of an IgG1, IgG2, IgG3 and IgG4 molecule are indicated herein below:

```
IgG1:
                                    (SEQ ID NO: 330)
E216PKSCDKTHTCPPCPAPELLG

IgG2:
                                    (SEQ ID NO: 331)
E216RKCCVECPPCPAPPVAGP

IgG3:
                                    (SEQ ID NO: 332)
ELKTPLGDTTHTCPRCPEPKSCDTPPPCPRCPE216PKSCDTPPPCPRCP
APELLG

IgG4:
                                    (SEQ ID NO: 333)
E216SKYGPPCPSCPAPEFLG.
```

In the context of the present invention, it is referred to amino acid positions in the $F_c$ domain, these amino acid positions or residues are indicated according to the EU numbering system as described, for example in Edelman, G. M. et al., Proc. Natl. Acad. USA, 63, 78-85 (1969).

With the inclusion of $F_c$-parts consisting of hinges, $C_{H2}$ and $C_{H3}$ domains, or parts thereof, into antigen binding proteins, more particularly into bispecific antigen binding proteins, the problem of unspecific immobilization of these molecules, induced by $F_c$:$F_c$-gamma receptor ($F_c\gamma$R) interactions arose. $F_c\gamma$Rs are composed of different cell surface molecules ($F_c\gamma$RI, $F_c\gamma$RIIa, $F_c\gamma$RIIb, $F_c\gamma$RIII) binding with differing affinities to epitopes displayed by $F_c$-parts of IgG-molecules. As such an unspecific (i.e. not induced by either of the two binding domains of a bispecific molecule) immobilization is unfavorable due to i) influence on pharmacokinetics of a molecule and ii) off-target activation of immune effector cells various $F_c$-variants and mutations to ablate $F_c\gamma$R-binding have been identified. In this context, Morgan et al. 1995, Immunology (The N-terminal end of the $C_{H2}$ domain of chimeric human IgG1 anti-HLA-DR is necessary for C1q, $F_c\gamma$RI and $F_c\gamma$RIII binding) disclose the exchange of the residues 233-236 of human IgG1 with the corresponding sequence derived from human IgG2, i.e. the residues 233P, 234V and 235A and wherein no amino acid is present at position 236, resulting in abolished $F_c\gamma$RI binding, abolished C1q binding and diminished $F_c\gamma$RIII binding. EP1075496 discloses antibodies and other $F_c$-containing molecules with variations in the $F_c$ region (such as one or more of 233P. 234V, 235A and no residue or G in position 236 and 3270, 330S and 331S) wherein the recombinant antibody is capable of binding the target molecule without triggering significant complement dependent lysis, or cell mediated destruction of the target.

Accordingly, in some embodiments, the $F_c$ region comprises or further comprise one or more of the amino acids or deletions selected from the group consisting of 233P, 234V, 235A, 236 (no residue) or G, 327G. 330S, 331S, preferably, the $F_c$ region comprises or further comprises the amino acids 233P, 234V, 235A, 236 (no residue) or G and one or more amino acids selected from the group consisting of 327G, 330S, 331 S, most preferably, the $F_c$ region comprises or further comprises the amino acids 233P, 234V, 235A, 236 (no residue) and 331 S.

In one further embodiment, the $F_c$ domain comprises or further comprises the amino acid substitution N297Q, N297G or N297A, preferably N2970.

The amino acid substitutions "N297Q", "N297G" or "N297A" refer to amino acid substitutions at position 297 that abrogate the native N-glycosylation site within the $F_c$-domain. This amino acid substitution further prevents $F_c$-gamma-receptor interaction and decreases the variability of the final protein products, i.e. the antigen binding proteins of the present invention, due to sugar residues as described for example in Tao, M H and Morrison, S L (J Immunol. 1989 Oct. 15; 143(8):2595-601.).

In one further embodiment, in particular when no light chain, the $F_c$ domain comprises or further comprises the amino acid substitution C220S. The amino acid substitution "C220S" deletes the cysteine forming the $C_{H1}$-$C_L$ disulphide bond.

In some embodiments, the $F_c$ domain comprises or further comprises at least two additional cysteine residues, for example S354C and Y349C or L242C and K334C, wherein S354C is in the $F_c$-domain of one polypeptide, such as $F_{c1}$, and Y349C is in the $F_c$ domain of the other polypeptide, such as $F_{c2}$, to form a heterodimer and/or wherein L242C and K334C are located in the same $F_c$-domain, either in the $F_{c1}$ or $F_{c2}$ of one or both polypeptides to form a intradomain C—C bond.

The antigen binding protein of the present disclosure can be synthetic, recombinant, isolated, engineered and/or purified.

By "purified" is meant, when referring to a polypeptide, e.g. to the antigen binding protein of the invention) or a nucleotide sequence. e.g. encoding antigen binding proteins or functional fragment thereof described herein, that the indicated molecule is present in the substantial absence of other biological macromolecules of the same type. The term "purified" as used herein in particular means that at least 75%, 85%, 95%, or 98% by weight, of biological macromolecules of the same type are present.

A purified nucleic acid molecule that encodes a particular polypeptide refers to a nucleic acid molecule that is substantially free of other nucleic acid molecules that do not encode the subject polypeptide; however, the molecule may include some additional bases or moieties, which do not deleteriously affect the basic characteristics of the composition.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated". An isolated nucleic acid or protein can exist in substantially purified form, or can exist in a non-native environment such as, for example, a host cell. An isolated antigen binding protein is substantially free of other antigen binding proteins having different antigenic specificities (e.g., an antigen binding protein that specifically binds PRAME is substantially free of antigen binding proteins that specifically bind antigens other than PRAME). Moreover, an isolated antigen binding protein may be substantially free of other cellular material and/or chemicals.

A "recombinant" molecule is one that has been prepared, expressed, created, or isolated by recombinant means. Recombinant molecules do not exist in nature.

The term "gene" means a DNA sequence that codes for, or corresponds to, a particular sequence of amino acids which comprises all or part of one or more proteins or enzymes, and may or may not include regulatory DNA sequences, such as promoter sequences, which determine for example the conditions under which the gene is expressed. Some genes, which are not structural genes, may be transcribed from DNA to RNA, but are not translated into an amino acid sequence. Other genes may function as regulators of structural genes or as regulators of DNA transcription. In particular, the term gene may be intended for the genomic sequence encoding a protein, i.e. a sequence comprising regulator, promoter, intron and exon sequences.

"Affinity" is defined, in the context of the present invention by the equilibrium binding between the antigen binding protein and its antigen, namely the PRAME-004 peptide according to SEQ ID NO: 50 in a complex with a MHC protein. Affinity may be expressed for example in half-maximal effective concentration ($EC_{50}$) or the equilibrium dissociation constant ($K_D$). In the context of the present invention, a high affinity refers to binding with a $K_D$ of ≤100 nM, ≤50 nM, ≤10 nM, or ≤5 nM.

"$K_D$" is the equilibrium dissociation constant, a ratio of $k_{off}/k_{on}$, between the antigen binding protein and its antigen. $K_D$ and affinity are inversely related. The $K_D$ value relates to the concentration of the antigen binding protein and the lower the $K_D$ value, the higher the affinity of the antigen binding protein. Affinity, i.e. the $K_D$ value, can be experimentally assessed by a variety of known methods, such as measuring association and dissociation rates with surface plasmon resonance (SPR) or bio-layer interferometry (BLI), as described in more detail herein below in the section 'Antigen binding proteins'. The $K_D$ is preferably measured by bio-layer interferometry (BLI). More preferably, the $K_D$ of the antigen binding protein to the PRAME antigenic peptide is determined at a temperature between 20° C. to 35° C., preferably 25° C. to 32° C., more preferably about 30° C., and a pH of 6.5 to 8.0, preferably 7.0 to 7.6, by BLI. Even more preferably, the $K_D$ of the antigen binding protein to the PRAME antigenic peptide is determined at a temperature between 20° C. to 35° C., preferably 25° C. to 32° C., more preferably about 30° C., a pH of 6.5 to 8.0, preferably 7.0 to 7.6, and a salt concentration of 100 to 200 mM, preferably 120 to 175 mM, more preferably about 140 mM by BLI. Most preferably, the $K_D$ of the antigen binding protein to the PRAME antigenic peptide is determined at 30° C. in a buffer comprising or consisting of PBS, 0.05% Tween-20 and 0.1% BSA by BLI. In such measurements, the concentration of the antigen binding protein is typically between 1.56-500 nM, depending on the affinity of the measured interaction. In instances where the $K_D$ of an antigen binding protein for two different peptides (e.g. target peptide and potential off-target peptide/similar peptide) is compared, the loading condition for the peptide-HLA is the same for for both measurements if the two peptides have a similar HLA binding strength, and the range of the antigen binding protein concentration is selected considering the expected affinity.

"Half maximal effective concentration" also called "$EC_{50}$", typically refers to the concentration of a molecule which induces a response halfway between the baseline and maximum after a specified exposure time. $EC_{50}$ and affinity are inversely related, the lower the $EC_{50}$ value the higher the affinity of the molecule. In one example, the "$EC_{50}$" refers to the concentration of the antigen binding protein of the invention which induces a response halfway between the baseline and maximum after a specified exposure time, more particularly, refers to the concentration of the antigen binding protein of the invention which induces a response halfway between the baseline and maximum after a specified exposure time. $EC_{50}$ values can be experimentally assessed by a variety of known methods, using for example binding assays such as ELISA or flow cytometry, or functional assays such as IFN-gamma release assay or lactate dehydrogenase (LDH) release assay.

Antigen Binding Proteins

The antigen binding proteins of the invention are engineered from a scaffold sequence into which a number of mutations are introduced. The antigen binding proteins of the invention have a particularly suitable profile for therapeutic use. In general, the identification of such antigen binding proteins is not straightforward and typically has a high attrition rate.

In the first instance, the skilled person needs to identify a suitable starting, or scaffold, sequence. For the present invention, this is a TCR having a good affinity for the target peptide-HLA complex, for example 200 μM or stronger; a high level of target specificity, e.g. relatively weak or no binding to alternative peptide-HLA complexes; which can be refolded and purified at high yield. Given the degenerate nature of TCR recognition, it is exceptionally hard even for the skilled in the art to determine whether a particular scaffold TCR sequence has a specificity profile that would make it eligible for engineering for therapeutic use (Wooldridge, et al., J Biol Chem. 2012 Jan. 6; 287(2): 1 168-77).

A particularly important step is to convert this TCR into a soluble format that can be stably expressed. Naturally occurring TCRs are membrane bound and are only expressed in complex with CD3. Other than antibodies that are routinely expressed as single chain variable fragment (scFv) molecules, the corresponding single-chain T cell receptor variable domain (scTv) constructs are prone to aggregation and misfolding (Richman, et al. Mol Immunol. 2009 February; 46(5):902-16. doi: 10.1016/j.molimm.2008.09.021. Epub 2008 Oct. 29.) This step is mandatory for the generation of an active biological substance, but might be also crucial for further engineering steps as described below. The process of scTv conversion and generation of a stable and soluble molecule typically involves engineering of one or more specific mutations in the framework regions and/or CDR(s), including but not limited to substitutions, insertions and/or deletions, on to the TCR starting sequence in order to increase the expression and stability of the scTv. Each TCR here has a different set of mutations, depending on the combination of variable domains as well as the composition of the CDR3s. The specific mutations and/or combinations of mutations that produce significant increases in solubility and stability are not predictable and there is a high attrition rate. In many cases, it may not be possible to achieve significant increases in solubility and stability with a given TCR starting sequence.

The next challenge is to engineer the TCR to have a higher affinity towards the target antigen whilst retaining desirable characteristics such as specificity and yield. TCRs, as they exist in nature, have weak affinity for target antigen (low micromolar range) compared with antibodies, and TCRs against cancer antigens typically have weaker antigen recognition than viral specific TCRs (Aleksic, et al. Eur J Immunol. 2012 December; 42(12):3174-9). This weak affinity coupled with HLA down-regulation on cancer cells means that therapeutic TCRs for cancer immunotherapy typically require engineering to increase their affinity for target antigen and thus generate a more potent response. Such affinity increases are essential for soluble TCR-based reagents. In such cases, antigen-binding affinities in the nanomolar to picomolar range, with binding half-lives of several hours, are desirable. The affinity maturation process, typically involves engineering of specific mutations in the CDR(s) and/or combinations of mutations in the CDR(s), including but not limited to substitutions, insertions and/or deletions, on to the starting TCR sequence in order to increase the strength of antigen recognition. To produce significant increases in the affinity of a given TCR against a given target, the skilled in the art may have to engineer combinations of mutations in the CDRs from a large pool of possible alternatives. The specific mutations and/or combinations of mutations that produce significant increases in affinity are not predictable and there is a high attrition rate. In many cases, it may not be possible to achieve significant increases in affinity with a given TCR starting sequence.

The affinity maturation process must also take account of the necessity of maintaining TCR antigen specificity. Increasing the affinity of a TCR for its target antigen brings a substantial risk of revealing cross reactivity with other unintended targets as a result of the inherent degeneracy of TCR antigen recognition (Wooldridge, et al., J Biol Chem. 2012 Jan. 6; 287(2): 1 168-77; Wilson, et al., Mol Immunol, 2004 February; 40(14-15): 1047-55; Zhao of al, J Immunol. 2007 Nov. 1; 179(9):5845-54). At a natural level of affinity, the recognition of the cross-reactive antigen may be too low to produce a response. If a cross reactive antigen is displayed on normal healthy cells, there is a strong possibility of off-target binding in vivo which may manifest in clinical toxicity. Thus, in addition to increasing antigen binding strength, the skilled person must also engineer mutations in the CDR(s) and or combinations of mutations in the CDR(s) that allow the TCR to retain a high specificity for target antigen and thus demonstrate a good safety profile in preclinical testing. Again, suitable mutations and/or combinations of mutations are not predictable. The attrition rate at this stage is even higher and, in many cases, may not be achievable at all from a given TCR starting sequence. Despite the difficulties described above, the inventors have identified antigen binding proteins comprising TCR derived CDRs with a particularly high affinity (low nanomolar range), and a high degree of antigen specificity.

Using the TCR R11P3D3, as disclosed in WO2018/172533, which is incorporated herein by reference, as starting point, the inventors have designed, produced and tested variants of the variable alpha and variable beta domain of R11P3D3 in a single-chain TCR (scTCR) format; optionally coupled to a Fab-fragment, and in a TCER® format, in this way the inventors identified different CDRs, in particular CDRa1, CDRa3, CDRb1 and CDRb3 and optionally CDRa2 and CDRb2, that are relevant for the antigen binding proteins of the invention to bind their target, i.e. a PRAME-004 peptide in a complex with a MHC protein, with high affinity and high specificity.

The inventors designed bispecific TCER® molecules, single chain TCRs (scTCRs) and bispecific scTCR-Fab molecules. All constructs specifically bind to the peptide-MHC complex comprising the PRAME-004 peptide. The bispecific constructs disclosed in the examples further bind to effector cells, in particular T cells, via an antibody-derived "recruiter". The inventors thus demonstrated that the CDRs may be used in single chain TCR constructs as well as in bispecific TCR-antibody molecules and thus demonstrated that the identified CDRs may be used to produce different antigen binding proteins having a high affinity and a high specificity to the PRAME-004 peptide in a complex with an MHC protein.

Accordingly, in a first aspect, the invention relates to an antigen binding protein specifically binding to a PRAME antigenic peptide that comprises or consists of the amino acid sequence SLLQHLIGL of SEQ ID NO: 50 and is in a complex with a major histocompatibility complex (MHC) protein, the antigen binding protein comprising a variable domain $V_A$ comprising complementarity determining regions (CDRs) CDRa1, CDRa2 and CDRa3, wherein the CDRa1 comprises or consists of the amino acid sequence of VKEFQD (SEQ ID NO: 16), or an amino acid sequence differing from SEQ ID NO: 16 by one, two or three amino acid mutations, preferably amino acid substitutions, and the CDRa3 comprises or consists of the amino acid sequence of ALYNNLDMR (SEQ ID NO: 33) or ALYNNYDMR (SEQ ID NO: 34), or an amino acid sequence differing from SEQ ID NO: 33 or SEQ ID NO: 34 by one, two or three, preferably one or two, amino acid mutations, preferably amino acid substitutions, and a variable domain $V_B$ comprising CDRb1, CDRb2 and CDRb3, wherein the CDRb1 comprises or consists of the amino acid sequence of SGHNS (SEQ ID NO: 10) or an amino acid sequence differing from SEQ ID NO: 10 by one, two or three, preferably one or two, amino acid mutations, preferably amino acid substitutions, and the CDRb3 comprises or consists of the amino acid sequence of $ASSX_1GX_2X_3DX_4QY$, wherein $X_1$ is P, A or T, preferably P, $X_2$ is A or S, preferably A, $X_3$ is T or I, and $X_4$ is T, K or A, preferably K or A, more preferably K, (SEQ ID NO: 327) or an amino acid sequence differing from SEQ ID NO: 327 by one, two or three amino acid mutations, preferably amino acid substitutions.

The specificity of the antigen binding protein is determined by the amino acid sequences CDRa1, CDRa3, CDRb1 and CDRb3 and does not depend on the amino acid sequences of CDRa2 and CDRb2.

In some embodiments, the CDRa2 comprises or consists of the amino acid sequence of SEQ ID NO: 32, or an amino acid sequence differing from SEQ ID NO: 32 by one, two or three amino acid mutations, preferably amino acid substitutions, and/or the CDRb2 comprises or consists of the amino acid sequence of SEQ ID NO: 36 or an amino acid sequence differing from SEQ ID NO: 36 by one, two, three, four, five or six, preferably not more than five, more preferably not more than four, even more preferably not more than three amino acid mutations, preferably amino acid substitutions.

In some embodiments, the antigen binding protein comprises the CDRa1, CDRb1, and optionally CDRa2 and CDRb2 as defined above, the CDRa3 comprises or consists of the amino acid sequence of SEQ ID NO: 33, or an amino acid sequence differing from SEQ ID NO: 33 by one, two or three, preferably one or two amino acid mutations, preferably amino acid substitutions, and the CDRb3 comprises or consists of the amino acid sequence of $ASSX_1GX_2X_3DX_4QY$ (SEQ ID NO: 327), wherein $X_1$ is P, A or T, preferably P, $X_2$ is A or S, preferably A, $X_3$ is T or I, and $X_4$ is T, K or A, preferably K or A, more preferably K, or an amino acid sequence differing from SEQ ID NO: 327 by one, two or three amino acid mutations, preferably amino acid substitutions.

In some embodiments, the antigen binding protein comprises the CDRa1, CDRb1, and optionally CDRa2 and CDRb2 as defined above, the CDRa3 comprises or consists of the amino acid sequence of SEQ ID NO: 34, or an amino acid sequence differing from SEQ ID NO: 34 by one, two or three, preferably one or two amino acid mutations, preferably amino acid substitutions, and the CDRb3 comprises or consists of the amino acid sequence of $ASSX_1GX_2X_3DX_4QY$ (SEQ ID NO: 327), wherein $X_1$ is P, A or T, preferably P, $X_2$ is A or S, preferably A, $X_3$ is T or I, and $X_4$ is T, K or A, more preferably K or A preferably K, or an amino acid sequence differing from SEQ ID NO: 327 by one, two or three amino acid mutations, preferably amino acid substitutions.

In preferred embodiments, the CDRb3 comprises or consists of the amino acid sequence of $ASSX_1GX_2X_3DX_4QY$ (SEQ ID NO: 364), wherein $X_2$ is A or S, preferably A, $X_3$ is T or I, and $X_4$ is T, K or A, preferably K or A, more preferably K, or an amino acid sequence differing from SEQ ID NO: 364 by one, two or three amino acid mutations, preferably amino acid substitutions.

In preferred embodiments, the CDRb3 comprises or consists of the amino acid sequence of $ASSPGX_2TDX_4QY$ (SEQ ID NO: 363), wherein $X_2$ is A or S, preferably A, and $X_4$ is T, K or A, preferably K or A, more preferably K, or an amino acid sequence differing from SEQ ID NO: 363 by one, two or three amino acid mutations, preferably amino acid substitutions.

In other preferred embodiments, the CDRb3 comprises or consists of the amino acid sequence of $ASSPGAX_3DX_4QY$ (SEQ ID NO: 365), wherein $X_3$ is T or I, preferably I, and $X_4$ is K or A, preferably K, or an amino acid sequence differing from SEQ ID NO: 365 by one, two or three amino acid mutations, preferably amino acid substitutions.

In some embodiments, the antigen binding protein comprises the CDRa1, CDRb1, and optionally CDRa2 and CDRb2 as defined above, the CDRa3 comprises or consists of the amino acid sequence of SEQ ID NO: 33, or an amino acid sequence differing from SEQ ID NO: 33 by one, two or, three, preferably one or two amino acid mutations, preferably amino acid substitutions, and the CDRb3 comprises or consists of the amino acid sequence of SEQ ID NO: 48, or an amino acid sequence differing from SEQ ID NO: 48 by one, two, three, or four, preferably one, two or three, more preferably one or two amino acid mutations, preferably amino acid substitutions.

In some embodiments, the antigen binding protein comprises the CDRa1, CDRb1, and optionally CDRa2 and CDRb2 as defined above, the CDRa3 comprises or consists of the amino acid sequence of SEQ ID NO: 33, or an amino acid sequence differing from SEQ ID NO: 33 by one, two or, three, preferably one or two amino acid mutations, preferably amino acid substitutions, and the CDRb3 comprises or consists of the amino acid sequence of SEQ ID NO: 48 or SEQ ID NO: 283, or SEQ ID NO: 281, or SEQ ID NO: 297 or an amino acid sequence differing from SEQ ID NO: 48, SEQ ID NO: 297, SEQ ID NO: 281 or SEQ ID NO: 283 by one, two or three, preferably one or two amino acid mutations, preferably amino acid substitutions.

In preferred embodiments, CDRa1, CDRa3, CDRb1, CDRb3 and optionally CDRa2 and CDRb2 differ from SEQ ID NO: 16, SEQ ID NO: 33 or 34, SEQ ID NO: 10, SEQ ID NO: 327, SEQ ID NO: 32 and SEQ ID NO: 36, respectively, by not more than two, preferably not more than one amino acid mutation, preferably amino acid substitution. In preferred embodiments, the amino acid substitutions in the CDRs are conservative substitutions.

The variable domain $V_A$ and the variable domain $V_B$ together form an antigen binding site that binds to the PRAME-004 antigenic peptide complexed with an MHC protein. Hereinafter, this antigen binding site is sometimes also referred to "first antigen binding site".

CDRa1, CDRa2 and CDRa3 are derived from a TCR α-chain variable domain and CDRb1, CDRb2 and CDRb3 are derived from a TCR β-chain variable domain.

Further to the CDRs, $V_A$ and $V_B$ comprise framework regions (FRs). The FR sequences may be TCR-derived, i.e. derived from a TCR α-, β-, γ- or δ-chain variable domain, or may be derived from an antibody variable domain. In an example, $V_A$ comprises the FR sequences of an antibody light chain variable domain and may thus be described as (FR1-L)-(CDRa1)-(FR2-L)-(CDRa2)-(FR3-L)-(CDRa3)-(FR4-L), and $V_B$ comprises the FR sequences of an antibody heavy chain variable domain and may thus be described as (FR1-H)-(CDRb1)-(FR2-H)-(CDRb2)-(FR3-H)-(CDRb3)-(FR4-H). It is preferred that $V_A$ comprises FR sequences of an α- or γ-, preferably α-chain variable domain and may thus be described as (FR1-a)-(CDRa1)-(FR2-a)-(CDRa2)-(FR3-a)-(CDRa3)-(FR4-a), and $V_B$ comprises FR sequences of an β- or δ-, preferably β-chain variable domain, and may thus be described as (FR1-b)-(CDRb1)-(FR2-b)-(CDRb2)-(FR3-b)-(CDRb3)-(FR4-b). In instances where the entire $V_A$ domain is derived from a TCR α-chain. $V_A$ may also be referred to as $V_\alpha$. In instances where the entire $V_B$ domain is derived from a TCR β-chain, $V_B$ may also be referred to as $V_\beta$.

In some embodiments,

Position 27 of CDRa1 according to IMGT is V or is substituted by an amino acid selected from L, I, M, F, A, T, N, Q, H, E, D and S, particularly selected from T, N, S and I, Position 28 of CDRa1 according to IMGT is K or is substituted by an amino acid selected from R, Q, H, N, A, V, S, G, L, I and T, particularly selected from R, A and S, Position 38 of CDRa1 according to IMGT is D or is substituted by an amino acid selected from E, N, Q, H, K and R, particularly N, Position 64 of CDRa2 according to IMGT is K or is substituted by an amino acid selected from R, Q, H, N, T, V, A, L, I, M and F, particularly selected from R, T and V, Position 114 of CDRa3 according to IMGT is L or Y or is substituted by an amino acid selected from M, W, H, Q, A, I, K, R, V, D, E, F and N particularly selected from H, Q, A, I, K, R, V, D, E, F and N, more particularly selected from H, Q, A and I, Position 56 of CDRb2 according to IMGT is F or is substituted by an amino acid selected from Y, M, L, W, H, V, I and A, particularly selected from Y, M and L, Position 57 of CDRb2 according to IMGT is Q or is substituted by an amino acid selected from N, R, D, E, C, H, K and K, particularly N, with the proviso that the amino acid at position 57 is not N when the amino acid at position 63 is T or S, Position 58 of CDRb2 according to IMGT is N or is substituted by an amino acid selected from Q, H, D, K, R, S and T, particularly S, Position 63 of CDRb2 according to IMGT is T or is substituted by an amino acid selected from S, V, A, D, Q and E, particularly selected from S and E, with the proviso that the amino acid at position 63 is not T or S when the amino acid at position 57 is N, Position 64 of CDRb2 according to IMGT is A or is substituted by an amino acid selected from V, L, I, S, G and T, particularly T, Position 65 of CDRb2 according to IMGT is V or is substituted by an amino acid selected from L, I, M, A, T, F and S, particularly selected from I, L and T, Position 108 of CDRb3 according to IMGT is P, A or T or is substituted by an amino acid selected from V, L, I, S, G, R, K, N and Q, particularly selected from R and S, with the proviso that the amino acid at position 108 is not N when the amino acid at position 110 is T or S, Position 110 of CDRb3 according to IMGT is A or S or is substituted by an amino acid selected from V, L, I, G, T and C, particularly T, with the proviso that the amino acid at position 110 is not T or S when the amino acid at position 108 is N, Position 113 of CDRb3 according to IMGT is T or I or is substituted by an amino acid selected from V, L, I, G and T, and Position 115 of CDRb3 according to IMGT is T, K or A or is substituted by an amino acid selected from G, L, I, V, R, Q, N, Y. H. E and F, particularly selected from L, I, V, R, Q, N, Y, H, E and F, more particularly from L, I, V and R.

In some embodiments,

CDRa1 comprises or consists of the amino acid sequence $X_1X_2EFQX_3$ (SEQ ID NO: 334), wherein $X_1$ is V, T, N, I or S, preferably V; T or N, most preferably V, $X_2$ is K, R, S or A, more preferably K or R, most preferably K, and $X_3$ is D or N, preferably D.

CDRa2 comprises or consists of the amino acid sequence FGPYGX$_1$E (SEQ ID NO: 335), wherein $X_1$ is K, R, T or V, preferably K or R, most preferably K, CDRa3 comprises or consists of the amino acid sequence ALYNNX$_1$DMR (SEQ ID NO: 336), wherein $X_1$ is L, Y, H, Q, A, I, K, R, V, D, E, F or N, preferably L, Y, H, Q, A, I, K or R, more preferably L, Y, H, Q or A, most preferably L or Y CDRb1 preferably comprises or consists of the amino acid sequence SEQ ID NO: 10 the CDRb2 comprises or consists of the amino acid sequence $X_1X_2X_3X_4X_5X_6$, wherein $X_1$ is F, Y, M or L, preferably F or Y, most preferably F, $X_2$ is Q or N, preferably Q (if $X_2$ is N, then $X_3$ is also N), $X_3$ is N or S, preferably N, $X_4$ is T, S, or E, preferably T or S, most preferably T (if $X_4$ is S, then $X_2$ is Q), $X_5$ is A or T, preferably A, and $X_5$ is V, I, L or T, preferably V or I, most preferably V (SEQ ID NO: 337), more preferably CDRb2 comprises or consists of the amino acid sequence $X_1QX_3TX_5X_6$ (SEQ ID NO: 359), wherein $X_1$ is F, Y, M or L, preferably F or Y, most preferably F, $X_3$ is N or S, preferably N, $X_5$ is A or T, preferably A, and $X_6$ is V, I, L or T, preferably V or I, most preferably V and CDRb3 comprises or consists of the amino acid sequence ASSX$_1$GX$_2$X$_3$DX$_4$QY (SEQ ID NO: 338), wherein $X_1$ is P, R, A, T, or S, preferably P, T or A, most preferably P, $X_2$ is A or S, preferably A, $X_3$ is T or I, preferably T, and $X_4$ is K, A, L, I, V, R, Q, N, Y, T, H, E or F, preferably K, A, L, I, V, R, Q N, or Y, more preferably K, A, L, I, V or R, most preferably K or A.

In some embodiments,

CDRa1 comprises or consists of an amino acid sequence selected from the group consisting of SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26. SEQ ID NO: 27 and SEQ ID NO: 28, CDRa2 comprises or consists of an amino acid sequence selected from the group consisting of sequence SEQ ID NO: 32, SEQ ID NO: 30, SEQ ID NO: 31 and SEQ ID NO: 29, CDRa3 comprises or consists of an amino acid sequence selected from the group consisting of SEQ ID NO: 33. SEQ ID NO: 34, SEQ ID NO: 227, SEQ ID NO: 233, SEQ ID NO: 219, SEQ ID NO: 229, SEQ ID NO: 231, SEQ ID NO: 235, SEQ ID NO: 237, SEQ ID NO: 221, SEQ ID NO: 223. SEQ ID NO: 225 and SEQ ID NO: 9, CDRb1 comprises or consists of amino acid sequence SEQ ID NO: 10

CDRb2 comprises or consists of an amino acid sequence selected from the group consisting of SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44 and SEQ ID NO: 35, and/or CDRb3 comprises or consists of an amino acid sequence selected from the group consisting of SEQ ID NO: 46, SEQ ID NO: 47, SEQ ID NO: 48, SEQ ID NO: 49, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 253, SEQ ID NO: 255, SEQ ID NO: 257, SEQ ID NO: 259, SEQ ID NO: 261, SEQ ID NO: 263, SEQ ID NO: 265, SEQ ID NO: 267, SEQ ID NO: 273, SEQ ID NO: 275, SEQ ID NO: 277, SEQ ID NO: 279, SEQ ID NO: 281, SEQ ID NO: 283, SEQ ID NO: 292, SEQ ID NO: 293, SEQ ID NO: 294, SEQ ID NO: 297, SEQ ID NO: 298, SEQ ID NO: 301, SEQ ID NO: 302 and SEQ ID NO: 271 and SEQ ID NO: 269.

Preferably, the antigen binding protein comprises the CDRa1 of SEQ ID NO: 16, CDRa3 of SEQ ID NO: 34, CDRb1 of SEQ ID NO: 10, CDRb3 of SEQ ID NO: 48 or 292, and optionally CDRa2 of SEQ ID NO: 32, and CDRb2 of SEQ ID NO: 36.

In a preferred example, the antigen binding protein comprises the CDRa1 of SEQ ID NO: 16, CDRa3 of SEQ ID NO: 34, CDRb1 of SEQ ID NO: 10, and CDRb3 of SEQ ID NO: 48, and optionally CDRa2 of SEQ ID NO: 32, and CDRb2 of SEQ ID NO: 36. Thus, the antigen binding protein may comprise the CDRa1 of SEQ ID NO: 16, CDRa3 of SEQ ID NO: 34, CDRb1 of SEQ ID NO: 10, CDRb3 of SEQ ID NO: 48, CDRa2 of SEQ ID NO: 32, and CDRb2 of SEQ ID NO: 36.

In another preferred example, the antigen binding protein comprises the CDRa1 of SEQ ID NO: 16, CDRa3 of SEQ ID NO: 34, CDRb1 of SEQ ID NO: 10, and CDRb3 of SEQ ID NO: 292, and optionally CDRa2 of SEQ ID NO: 32, and CDRb2 of SEQ ID NO: 36. Thus, the antigen binding protein may comprise the CDRa1 of SEQ ID NO: 16, CDRa3 of SEQ ID NO: 34, CDRb1 of SEQ ID NO: 10, CDRb3 of SEQ ID NO: 292, CDRa2 of SEQ ID NO: 32, and CDRb2 of SEQ ID NO: 36.

It is preferred that the antigen binding protein comprises the CDRa1 of SEQ ID NO: 16, CDRa3 of SEQ ID NO: 33, SEQ ID NO: 34, or SEQ ID NO: 9, CDRb1 of SEQ ID NO: 10, CDRb3 of SEQ ID NO: 48, SEQ ID NO: 49, SEQ ID NO: 47, SEQ ID NO: 281, SEQ ID NO: 292, SEQ ID NO: 294, SEQ ID NO: 297, SEQ ID NO: 298, SEQ ID NO: 301 or SEQ ID NO: 283 and optionally CDRa2 of SEQ ID NO: 32, and CDRb2 of SEQ ID NO: 36 without modifications.

In some embodiments, the PRAME antigenic peptide consists of SEQ ID NO: 50.

In some embodiments, the antigen binding protein specifically binds to the amino acid sequence of SEQ ID NO: 50 in a complex with an MHC protein.

In some embodiments, the MHC protein is an MHC class I HLA protein, such as HLA-A, HLA-B or HLA-C, preferably HLA-A, more preferably HLA-A*02.

In a preferred embodiment, the antigen binding protein specifically binds to the structural epitope of the PRAME-004 antigenic peptide of SEQ ID NO: 50. In a more preferred embodiment the antigen binding protein specifically binds to the functional epitope of the PRAME-004 antigenic peptide of SEQ ID NO: 50.

The inventors performed experiments in order to identify residues of PRAME-004 that are relevant for binding by the antigen binding proteins of the invention (FIG. 5, Table 4, 10, 12, 16). As a result, the inventors could identify amino acid positions 3, 5, 6, 7 and 8 of SEQ ID NO: 50 to be relevant for binding. The amino acid at position 3 is strongly recognized by the antigen binding proteins of the invention. The amino acids at position 5 is also strongly recognized. Most strongly recognized is the amino acid at position 7. The amino acids at position 6 and 8 made a minor contribution. Positions 3, 5, and 7 and optionally 6 and 8 of SEQ ID NO: 50 are herein also referred to as "binding motif" of PRAME-004. The skilled in the art is aware that determination of the exact epitope or functional epitope might slightly vary depending on the method used and the cut-off values chosen.

In some embodiments, the antigen binding protein specifically binds to a functional epitope comprising or consisting of 3, 4 or 5 amino acid positions selected from the group consisting of positions 3, 5, 6, 7 and 8, in particular 3, 5 and 7 of SEQ ID NO: 50. In some embodiments, the antigen binding protein specifically binds to a functional epitope comprising the amino acid positions 3, 5 and 7 of SEQ ID NO: 50. In some embodiments, the antigen binding protein specifically binds to a functional epitope consisting of the amino acid positions 3, 5 and 7, or 3, 5, 6 and 7, or 3, 5, 7 and 8 or 3, 5, 6, 7 and 8 of SEQ ID NO: 50, preferably not amino acid positions 1 and 4 of SEQ ID NO: 50. In other words, the antigen binding protein specifically binds to the amino acid positions 3, 5 and 7, and optionally 6 and/or 8, preferably not 1 or 4, of SEQ ID NO: 50, preferably in a complex with a MHC protein, in particular a HLA protein, more particularly HLA-A, even more particularly HLA-A*02. In one embodiment, the antigen binding protein of the present disclosure specifically binds to a functional epitope comprising at least 3 amino acid positions selected from the group consisting of positions 3, 5, 6, 7 and 8 of SEQ ID NO:

50, provided that the antigen binding protein does not bind amino acid positions 1 and 4 of SEQ ID NO: 50. In one embodiment, the antigen binding protein specifically binds to a functional epitope comprising or consisting of at least 6 or 7 amino acid positions selected from the group consisting of positions 1, 3, 4, 5, 6, 7 and 8 of SEQ ID NO: 50

An amino acid sequence according to SEQ ID NO: 50, wherein at least one position is substituted, is in the context of the present specification referred to as "PRAME variant sequence". In particular, one position is substituted into alanine (SEQ ID NOs: 318-324). Peptides having a PRAME variant sequence are herein also referred to as PRAME variant peptides. In one embodiment, the antigen binding protein of the present invention binds to PRAME variant peptides, in which at least one of the positions 1, 3, 4, 5, 6, 7 and 8, particularly one of the positions 3, 5, 6, 7 and 8, more particularly one of the positions 3, 5 and 7 is substituted into an alanine, in a complex with a MHC protein, with reduced affinity, in particular with a $K_D$ that is increased by a factor of $\geq 2$, $\geq 5$, $\geq 10$, $\geq 20$, or $\geq 30$ compared to the $K_D$ for binding to the PRAME antigenic peptide of SEQ ID NO: 50. Preferably, the $K_D$ is determined as specified in the definitions section above.

When used in the antigen binding proteins of the invention, in particular in bispecific antigen binding proteins, more particularly in a TCER® format, the CDR amino acid sequences identified by the inventors increase binding affinity, stability and specificity of the antigen binding proteins, in particular in comparison to a reference protein.

A "reference protein" herein refers to a protein to which the antigen binding protein of the invention is compared. The comparison of the antigen binding protein of the invention and the reference protein is carried out under similar, preferably identical experimental conditions, preferably in parallel. Such a reference protein may be an antigen binding protein comprising the CDRs of the parental/wildtype TCR R11P3D3, which is disclosed in WO2018/172533. The reference protein is preferably in the same format as the antigen binding protein with which it is compared. In instances where the antigen binding protein is a scTCR, a suitable reference protein is scTCR R11P3D3SD (SEQ ID NO: 6), which comprises the variable domains of TCR R11P3D3 including stabilizing mutations. For example, the reference protein may be a TCER® as herein described comprising the CDRs of TCR R11P3D3. Alternatively, the reference protein is an antigen binding protein, for instance a TCER®, comprising the CDRs of "CDR6". The CDRs of "CDR6" are a CDRa1 of amino acid sequence DRGSQS (SEQ ID NO: 339), a CDRa2 of amino acid sequence IYSNGD (SEQ ID NO: 340), a CDRa3 of amino acid sequence AAVIDNDQGGILT (SEQ ID NO: 341), a CDRb1 of amino acid sequence PGHRA (SEQ ID NO: 342), a CDRb2 of amino acid sequence YVHGEE (SEQ ID NO: 343), and a CDRb3 of amino acid sequence ASSPWD-SPNVQY (SEQ ID NO: 344). The reference protein may be a CDR6 TCER® (TPP-1109) comprising a first polypeptide chain comprising or consisting of SEQ ID NO: 153 and a second polypeptide chain comprising or consisting of SEQ ID NO: 154. TPP-1109 comprises the UCHT1(V17) recruiter corresponding to SEC ID NOs 108 and 109. Furthermore, the reference protein may be a CDR6 scTCR with a polypeptide chain comprising or consisting of SEQ ID NO: 357. The inventors show in the examples that an antigen binding protein comprising the CDRs of CDR6, in particular TCER® TPP-1109, binds to the amino acids at position 5, 6, 7, and 8, but not 2 and 3 of the PRAME-004 antigenic peptide (Table 16). Thus, antigen binding proteins comprising the CDRs of CDR6 do not bind to amino acid 3 of the PRAME-004 antigenic peptide, which is, in contrast, strongly bound/recognized by the antigen binding proteins of the invention.

Affinity

The antigen binding proteins of the invention comprise CDR sequences selected to provide for increased affinity towards a PRAME-004:MHC complex (FIG. 2, Table 3). As can be seen from the examples (Tables 4, 8, 10, 12, 15 and 16), the antigen binding proteins of the invention bind to the PRAME-004:MHC complex with high affinity, in particular with a $K_D$ of ≤50 nM, ≤10 nM, ≤5 nM or ≤3 nM.

Accordingly, in one embodiment, the antigen binding proteins of the invention have an increased affinity, in particular in comparison to a reference protein.

In one embodiment, the antigen binding protein of the invention binds to a complex of the PRAME peptide comprising or consisting of the amino acid sequence of SEQ ID NO: 50 and a HLA molecule, preferably HLA-A*02, with a $K_D$ which is ≤100 nM, ≤50 nM, ≤10 nM, preferably ≤5 nM, more preferably ≤3 nM, for instance 10 pM to 100 nM, 10 pM to 50 nM, 10 pM to 10 nM, 10 pM to 5 nM, 10 pM to 3 nM.

In one example, the antigen binding protein of the invention is a scTCR-Fab and binds to a complex of the PRAME peptide comprising or consisting of the amino acid sequence of SEQ ID NO: 50 and a HLA molecule, preferably HLA-A*02, with a $K_D$ which is ≤100 nM, ≤50 nM, ≤40 nM, ≤30 nM, ≤20 nM≤15 nM, preferably ≤15 nM, for instance 10 pM to 100 nM, 10 pM to 50 nM, 10 pM to 20 nM, 5 nM to 20 nM.

In one further example, the antigen binding protein of the invention is a TCER and binds to a complex of the PRAME peptide comprising or consisting of the amino acid sequence of SEQ ID NO: 50 and a HLA molecule, preferably HLA-A*02, with a $K_D$ which is ≤100 nM, ≤50 nM, ≤10 nM, preferably ≤5 nM, more preferably ≤3 nM, for instance 10 pM to 100 nM. 10 pM to 50 nM, 10 pM to 10 nM, 10 pM to 5 nM, 10 pM to 3 nM.

Methods to measure the affinity, such as the $K_D$, are known to the skilled in the art and include, for example, surface plasmon resonance (SPR) and bio-layer interferometry. An exemplary method to determine the $K_D$ is also described in the examples section. As is known to the skilled in the art, the experimental conditions used for those experiments, such as buffer used, concentration of the protein, can strongly influence the results.

Accordingly, in one example, the antigen binding proteins of the invention are expressed, for instance, as TCER® and are analyzed for their binding affinity towards HLA-A*02: PRAME-004 monomers. Typically, measurements are performed, for instance, on an Octet RED384 system using, typically, settings recommended by the manufacturer. Briefly, binding kinetics were, typically, measured at 30° C., and, for instance, 1000 rpm shake speed using, for example, PBS, 0.05% Tween-20, 0.1% BSA as buffer. The peptide-HLA complexes, in particular, the HLA-A*02/PRAME-004 complex was loaded onto biosensors, such as HIS1K, prior to analyzing serial dilutions of the TCER®.

As disclosed herein, the antigen binding proteins of the invention specifically bind to a complex of the PRAME antigenic peptide comprising or consisting of amino acid sequence of SEQ ID NO: 50 and a HLA molecule, preferably HLA-A*02. If the antigen binding protein is a TCR expressed on a T cell, the binding of the antigen binding protein to said complex may elicit an immune response upon binding. Accordingly, in one embodiment, the antigen binding protein of the present invention induces an immune response, preferably wherein the immune response is characterized by an increase in interferon gamma (IFNγ) levels.

Yield

The inventors demonstrate in the examples (Tables 5, 6, 7, 9, 11 and 14) that the antigen binding proteins have a high final product yield, in particular a yield of ≥1 mg/l, ≥1.5 mg/l, ≥2 mg/l, ≥5 mg/l, ≥10 mg/l, ≥15 mg/l, ≥20 mg/l, ≥30 mg/l, ≥40 mg/l, ≥50 mg/l, ≥60 mg/l.

The inventors demonstrate in the examples (Tables 5, 6, 7, 9, 11 and 14) that the antigen binding proteins have a high final product yield, in particular a yield that is increased in comparison to a reference protein, more particularly in comparison to an antigen binding protein comprising the CDRs of "CDR6" expressed in identical conditions.

In one example, the antigen binding protein is a scTCR-Fab (as described in Example 2) and has a product yield of ≥8 mg/l, ≥10 mg/l, ≥15 mg/l, ≥20 mg/l, ≥30 mg/l, ≥40 mg/l, ≥50 mg/l, ≥60 mg/l, ≥70 mg/l, such as 8 mg/l to 85 mg/1.10 mg/l to 85 mg/l, 14 mg/l to 85 mg/l, 50 mg/l to 85 mg/l.

In one another, the antigen binding protein is a TCER comprising VL and VH of the Recruiter UCHT1V17 and has a product yield of ≥10 mg/l, ≥12 mg/l, ≥15 mg/l, ≥16 mg/l, ≥17 mg/l, ≥18 mg/l, preferably a ≥15 mg/l, such as 10 mg/l to 30 mg/l, 15 mg/l to 25 mg/l, 15 mg/l to 30 mg/l, preferably 15 mg/l to 30 mg/l.

The final product yield is typically determined 10-11 days after transfection. Methods to measure the product yield are known to the skilled in the art. An exemplary procedure is described in the examples section.

Accordingly, in one embodiment, the antigen binding proteins of the invention have an improved yield, in particular in comparison to a reference protein, when expressed in identical conditions.

Stability

The inventors demonstrate in the examples (Tables 5, 6, 7, 9, 11 and 14) that the antigen binding proteins have a high stability.

The term "stability" in the context of the present invention refers to physical stability and can be evaluated qualitatively and/or quantitatively using various analytical techniques that are described in the art and are reviewed in for example Peptide and Protein Drug Delivery, 247-301, Vincent Lee Ed., Marcel Dekker, Inc., New York, N.Y., Pubs. (1991) and Jones, A. Adv. Drug Delivery Rev. 10: 29-90 (1993). In order to measure stability, a sample which comprises the antigen binding protein of the invention may be tested in a stability study, wherein a sample is exposed for a selected time period to a stress condition followed by quantitative and optionally qualitative analysis of the chemical and physical stability using an adequate analytical technique. In the context of the present invention, those methods refer in particular to the evaluation of aggregate formation (for example using size exclusion chromatography (SEC)), by measuring turbidity (for example by dynamic light scattering (DLS) or light obscuration (LO)) and/or by visual inspection (for example by determining colour and clarity). A sample is considered stable when there is only low aggregation as defined below.

In the context of the present invention, an improved stability refers for example to an increased physical stability when exposed to thermal stress. The newly developed antigen binding proteins of the invention can thus, better withstand stress conditions, especially thermal stress than the reference protein.

"Low aggregation" means, for example, that a sample comprising the antigen binding protein, after having been exposed to a stress condition, such as, to a temperature of
40° C. for 14 days in a buffer, such as PBS, has a monomer
content of ≥80%, ≥85%, ≥90%, ≥94%, ≥95%, ≥96%, ≥97%,
≥98%, ≥99%, such as a monomer content of 94% to 99%,
95% to 99%, 96% to 99%, 97% to 99%, typically, when
measured by SEC, such as SEC-HPLC, in a buffer, such as
PBS. For SEC, a difference of 1%, 2%, 3%, 4%, preferably
1 or 2%, more preferably 1%, of the monomer content is
considered as significantly different in the context of the
invention under the tested conditions depending on the
column used, operating pressure, and velocity of the buffer.
In other words, when the reference antigen binding protein
has a monomer content of 96% and the antigen binding
protein of the invention has a monomer content of 97%, the
monomer content of the antigen binding protein of the
invention is significantly different and thus significantly
increased in comparison to the reference antigen binding
protein, when measured in the same conditions.

The inventors demonstrate (Tables 5, 6, 7, 9, 11 and 14)
that the antigen binding proteins are stable, in particular they
have a monomer content of ≥80%, ≥85%, ≥90%, ≥92%,
≥94%, ≥95%, ≥97% after 14 days at 40° C. for in a buffer,
such as PBS.

In one embodiment, the antigen binding proteins of the
present invention are stable or have an improved stability, in
particular in comparison to a reference protein, when
exposed to stress condition for a certain period of time, such
as when exposed for 14 days to a temperature of 40° C.

In one embodiment, the antigen binding proteins of the
present invention show no or only low aggregation or show
reduced aggregation, in particular in comparison to a refer-
ence protein, when exposed to stress condition for a certain
period of time, such as when exposed for 14 days to a
temperature of 40°.

Specificity

The inventors demonstrate in the examples (FIGS. 3-6,
Tables 3, 4, 8, 13, 15) that the antigen binding proteins of the
present invention bind the target antigen. i.e. the PRAME
antigenic peptide comprising SEQ ID NO: 50 in a complex
with a MHC protein, preferably in complex with HLA-
A*02, with high specificity.

As described above, the inventors identified amino acid
positions 3, 5, 6, 7 and 8, in particular 3, 5 and 7 of SEQ ID
NO: 50 to be relevant for binding of the antigen binding
proteins of the invention to the PRAME-004 antigenic
peptide, i.e. to the "binding motif" of the PRAME-004
antigenic peptide. The inventors identified potential off-
target peptides that are, for example, similar to the sequence
and/or motif of PRAME-004, and thus have an increased
risk of being bound by an antigen binding protein binding to
PRAME-004.

In the context of the present invention "similar peptides"
herein refers to potential off-target peptides, i.e. peptides that
may potentially be bound by the antigen binding proteins of
the invention based on their biochemical/biophysical char-
acteristics, including but not limited to a homologous
sequence or a similar motif. Similar peptides comprise
typically 8 to 11 amino acids in length. The similar peptides
in the context of the present invention are typically MHC
presented. Furthermore, similar peptides in the context of
the present invention include peptides that comprise or
consists of an amino acid sequence that is similar to the
amino acid sequence of the PRAME-004 antigenic peptide,
more particular, peptides that, in comparison to the epitope
of the PRAME-004 antigenic peptide, comprise an epitope
wherein some or all amino acids have identical and/or
similar biochemical/biophysical characteristics as the amino acids that constitute the epitope of the PRAME-004 peptide.
In some examples, similar peptides investigated in the
context of the present invention were selected from a
database of tumor and normal tissue-presented HLA-A*02
bound peptides (XPRESIDENT® database) using a similar-
ity scoring within the binding-relevant positions of
PRAME-004 and the requirement of at least one detection
on normal tissues. Binding of an antigen binding protein to
a similar peptide presented by an MHC protein may lead to
adverse reactions. Such adverse reactions may be "off-
tumor" side effects, such as cross-reactivity of a specific
TCR with a similar peptide in healthy tissues as reported in
Lowdell et al., Cytotherapy, published on Dec. 4, 2018).

In particular, the following peptides are similar peptides
in the context of the present invention: TMED9-001 (SEQ
ID NO: 51), CAT-001 (SEQ ID NO: 52), DDX60L-001
(SEQ ID NO: 53), LRRC70-001 (SEQ ID NO: 54), PTPLB-
001 (SEQ ID NO: 55), HDAC5-001 (SEQ ID NO: 56),
VPS13B-002 (SEQ ID NO: 57), ZNF318-001 (SEQ ID NO:
58), CCDC51-001 (SEQ ID NO: 59), IFT17-003 (SEQ ID
NO: 60), DIAPH1-004 (SEQ ID NO: 62), FADS2-001 (SEQ
ID NO: 63), FRYL-003 (SEQ ID NO: 64), GIMAP8-001
(SEQ ID NO: 65), HSF1-001 (SEQ ID NO: 66), KNT-001
(SEQ ID NO: 67), MAU-001 (SEQ ID NO: 68), MCM4-001
(SEQ ID NO: 69), MPPE1-001 (SEQ ID NO: 71), MYO1B-
002 (SEQ ID NO: 72), PRR12-001 (SEQ ID NO: 73),
PTRF-003 (SEQ ID NO: 74), RASGRP1-001 (SEQ ID NO:
75), SMARCD1-001 (SEQ ID NO: 76), TGM2-001 (SEQ
ID NO: 77), VAV1-001 (SEQ ID NO: 78), VIM-009 (SEQ
ID NO: 317) FARSA-001 (SEQ ID NO: 306), ALOX15B-
003 (SEQ ID NO: 304), FAM114A2-002 (SEQ ID NO:
305), GPR56-002 (SEQ ID NO: 307), IGHD-002 (SEO ID
NO: 308), NOMAP-3-0972 (SEQ ID NO: 309), NOMAP-
3-1265 (SEQ ID NO: 310), NOMAP-3-1408 (SEQ ID NO:
311), NOMAP-3-1587 (SEQ ID NO: 312), NOMAP-3-1768
(SEQ ID NO: 313), NOMAP-5-0765 (SEQ ID NO: 314),
PDCD10-004 (SEQ ID NO: 315), TSN-001 (SEQ ID NO:
316), ARMC9-002 (SEQ ID NO: 187). CU-001 (SEQ ID
NO:188), COPG1-001 (SEQ ID NO: 190), COPS7A-001
(SEQ ID NO: 192), EIF-009 (SEQ ID NO: 194), EXT2-006
(SEQ ID NO: 196), LMNA-001 (SEQ ID NO: 198), PKM-
005 (SEQ ID NO: 200), PSMB3-002 (SEQ ID NO: 202),
RPL-007 (SEQ ID NO: 204), SPATS2L-003 (SEQ ID NO:
206), SYNE1-002 (SEQ ID NO: 208), TGM2-002 (SEQ ID
NO: 210) and TPR-004 (SEQ ID NO: 212).

The term "specificity" generally denotes the capacity of
an antigen binding protein to discriminate the target peptide
from a similar peptide as defined above. In other words, the
antigen binding protein binds to the PRAME-004:MHC
complex with high affinity, in particular with a $K_D$ below
100 nM, below 50 nM, below 10 nM, preferably below 5
nM, but does not significantly bind to similar peptide:MHC
complexes.

The skilled person is aware that among the similar pep-
tides, there will be some that are not bound by the antigen
binding proteins of the invention to a detectable degree, e.g.
peptides for which no binding signal or functional response
beyond the background level is detectable, wherein "back-
ground level" refers to a binding signal or functional
response observed for a non-homologous, "non similar"
peptide, or in the absence of a peptide.

For other similar peptides, a very low binding, however
no significant binding, may be detectable. These latter
similar peptides may also be described as "potentially rel-
evant" similar peptides. The expressions "no significant
binder", "does not significantly bind" signify that an antigen
binding protein:

1) binds (e.g. to a similar peptide:MHC complex) with a $K_D$ that is increased by a factor of ≥25, ≥30, ≥40, ≥50, ≥75, or ≥100, compared to the $K_D$ for binding to the PRAME-004 peptide:MHC complex;

2) shows a significantly reduced "functional response" (e.g. to a similar peptide:MHC complex) compared to the functional response to the PRAME-004 peptide:MHC complex; or 3) shows a significantly reduced detection with labelled similar peptide:MHC multimers compared to detection with PRAME-004 peptide:MHC multimers.

The affinity, in particular the $K_D$, are preferably measured using bio-layer interferometry (BLI) as described in the examples section. An increase of the $K_D$ for binding to the similar peptide:MHC complex compared to the $K_D$ for binding to the PRAME-004 peptide:MHC complex can also be expressed as ratio of the two Kos. For example, if the $K_D$ for binding to the similar peptide:MHC complex is increased by a factor of 100 compared to the $K_D$ for binding to the PRAME-004 peptide:MHC complex, the $K_D$-ratio "similar peptide/PRAME-004" is 100. The skilled in the art is aware that the affinity for a similar peptide:MHC complex may not be measurable if the binding is too weak.

A "functional response" refers to a response measured in a functional assay, for example, in an activation assay, such as an IFN-gamma release assay or in a cytotoxicity assay, such as a LDH release assay described in the experimental section herein below. The IFN-gamma release assay measures IFN-gamma released by T cells that are exposed to their specific peptide:MHC complex. The LDH release assay measures LDH that is released from target cells expressing on their surface a peptide:MHC complex and that are killed by T cells specifically binding to this peptide:MHC complex. The binding may be directly via a TCR expressed on the T cell or indirectly via a soluble bispecific molecule that binds to the peptide:MHC complex and to the T cell (i.e. recruits the T cell). A functional response in an IFN-gamma release assay is considered significantly reduced if the $EC_{50}$ is increased by a factor of ≥25, ≥30, ≥40, ≥50, ≥75, or ≥100, preferably ≥200, ≥300, ≥500, or ≥1000, compared to the $EC_{50}$ for binding to the PRAME-004 peptide:MHC complex. A functional response in a LDH release assay is considered significantly reduced if the $EC_{50}$ is increased by a factor of ≥25, ≥30, ≥40, ≥50, ≥75, or ≥100, preferably a 200, ≥300, ≥500, or ≥1000, compared to the $EC_{50}$ for binding to the PRAME-004 peptide:MHC complex.

Detection with labelled similar peptide:MHC multimers in particular refers to staining with similar peptide:MHC tetramers, wherein the antigen binding protein is expressed on the surface of a cell, preferably a yeast cell (example 1.1 and 1.2). The detection is considered significantly reduced if the number of positive (i.e. stained) cells is ≤5%, ≤3%, or ≤1% of the total number of cells, or if the number of positive cells is ≥10%, ≥5%, or ≥2.5% of the positive cells stained with a PRAME-004 peptide:MHC tetramer, or if the $EC_{50}$ is reduced by a factor of ≥50, ≥75, ≥100, ≥150, ≥200.

The antigen binding proteins of the present invention are engineered to have a high affinity for the target peptide, while avoiding binding to similar peptides. This is an important advantage of the antigen binding proteins of the present invention since binding to similar peptides increases the risk of side effects when present on normal tissue. Accordingly, the fact that the antigen binding proteins of the Invention bind similar peptides only with low affinity makes it a promising anti-cancer treatment with regard to safety.

The inventors demonstrate that the antigen binding proteins, in particular TCER® molecules cause cytolysis in T2 cells loaded with target peptide PRAME-004 by LDH release assay (Table 17). The inventors further demonstrate that the antigen binding proteins, in particular TCER® molecules cause cytolysis in a PRAME-positive tumor cell line by LDH release assay while a PRAME-negative tumor cell line was not affected by co-incubation with the TCER® molecules (FIG. 7-9). These in vitro-experiments further evidence the safety of the antigen binding proteins of the invention and document that the cytotoxic effect is highly selective for PRAME-positive tumor tissue. The molecules of the inventions therefore, show beneficial safety profiles.

In some embodiments, the antigen binding proteins of the invention do not significantly bind to at least 1, at least 2, at least 3, at least 4, at least 5, at least 10, at least 20 or all similar peptides selected from the group consisting of TMED9-001, CAT-001, DDX60L-001, LRRC70-001, PTPLB-001, HDAC5-001, VPS13B-002, ZNF318-001, CCDC51-001, IFT17-003, DIAPH1-004, FADS2-001, FRYL-003, GIMAP8-001, HSF1-001, KNT 001, MAU-001, MCM4-001, MPPE1-001, MYO1B-002, PRR12-001, PTRF-003, RASGRP1-001, SMARCD1-001, TGM2-001, VAV1-001, VIM-009, FARSA-001, ALOX15B-003, FAM114A2-002, GPR56-002, IGHD-002, NOMAP-3-0972, NOMAP-3-1265, NOMAP-3-1408, NOMAP-3-1587, NOMAP-3-1768, NOMAP-5-0765, PDCD10-004, TSN-001, ARMC9-002, CLI-001, COPG1-001, COPS7A-001, EIF-009, EXT2-006, LMNA-001, PKM-005, PSMB3-002, RPL-007, SPATS2L-003, SYNE1-002, TGM2-002 and TPR-004, in a complex with MHC.

In a preferred embodiment, the antigen binding proteins of the invention do not significantly bind to IFT17-003 in a complex with MHC.

In some embodiments, the antigen binding proteins of the invention show a significantly reduced functional response to at least 1, at least 2, at least 3, at least 4, at least 5, at least 10, at least 20 or all similar peptides selected from the group consisting of TMED9-001, CAT-001, DDX60L-001, LRRC70-001, PTPLB-001, HDAC5-001, VPS13B-002, ZNF318-001, CCDC51-001, IFT17-003, DIAPH1-004, FADS2-001, FRYL-003, GIMAP8-001, HSF1-001, KNT-001, MAU-001, MCM4-001, MPPE1-001, MYO1B-002, PRR12-001, PTRF-003, RASGRP1-001, SMARCD1-001, TGM2-001, VAV1-001, VIM-009, FARSA-001, ALOX15B-003, FAM114A2-002, GPR56-002, IGHD-002, NOMAP-3-0972, NOMAP-3-1265, NOMAP-3-1408, NOMAP-3-1587, NOMAP-3-1768, NOMAP-5-0765, PDCD10-004, TSN-001, ARMC9-2, CLI-001, COPG1-001, COPS7A-001, EIF-009, EXT2-006. LMNA-001, PKM-005, PSMB3-002, RPL-007, SPATS2L-003, SYNE1-002, TGM2-002 and TPR-004, in a complex with MHC, compared to the functional response to the PRAME-004 peptide:MHC complex. In a preferred embodiment, the antigen binding proteins of the invention show a significantly reduced functional response to IFT17-003 in a complex with MHC, compared to the functional response to the PRAME-004 peptide:MHC complex.

In some embodiments, the antigen binding proteins of the invention, particularly soluble bispecific antigen binding proteins, more particularly antigen binding proteins of the TCER® format, bind to at least 1, at least 2, at least 3, at least 4, at least 5, at least 10, at least 15 or all similar peptides selected from the group consisting of TMED9-001, CAT-001, DDX60L-001, LRRC70-001, PTPLB-001. HDAC5-001, VPS13B-002, ZNF318-001, CCDC51-001, IFT17-3, DIAPH1-004, FADS2-001, FRYL-003, GIMAP8-001, HSF1-001, KNT-001, MAU-001, MCM4-001, MPPE1-001, MYO1B-002, PRR12-001, PTRF-003, RASGRP1-001, SMARCD1-1, TGM2-001, VAV1-001, VIM-009, FARSA-001, ALOX15B-003, FAM114A2-002, GPR56-2, IGHD-002, NOMAP-3-0972, NOMAP-3-1265. NOMAP-3-1408, NOMAP-3-1587, NOMAP-3-1768, NOMAP-5-0765, PDCD10-004, TSN-001, ARMC9-002, CLI-001, COPG1-001, COPS7A-001, EIF-009, EXT2-006, LMNA-001, PKM-005, PSMB3-002, RPL-007, SPATS2L-003, SYNE1.002, TGM2-002 and TPR-004, in particular selected from the group consisting of GIMAP8-001, MYO1B-002, SMARCD1-001, VIM-009, FARSA-001, ALOX15B-3, FAM114A2-002, GPR56-002, IGHD-002, NOMAP-3-0972, NOMAP-3-1265, NOMAP-3-1408, NOMAP-3-1587, NOMAP-3-1768, NOMAP-5-0765, PDCD10-004, TSN-001, and/or from the group consisting of ARMC9-002, CLI-001, COPG1-001, COPS7A-001, EIF-009, EXT2-006, LMNA-001. PKM-005, PSMB3-002, RPL-007, SPATS2L-003, SYNE1-002, TGM2-002 and TPR-004, in a complex with MHC with a $K_D$ that is increased by a factor of $\geq 25$, $\geq 30$, $\geq 40$, $\geq 50$, $\geq 75$, or $\geq 100$, compared to the $K_D$ for binding to the PRAME-004 peptide:MHC complex. In a preferred embodiment, the antigen binding proteins of the invention, particularly soluble bispecific antigen binding proteins, more particularly antigen binding proteins of the TCER® format, bind to IFT17-003 in a complex with MHC with a $K_D$ that is increased by a factor of $\geq 25$, $\geq 30$, $\geq 40$, $\geq 50$, $\geq 75$, or $\geq 100$, compared to the $K_D$ for binding to the PRAME-004 peptide:MHC complex.

In some embodiments, the antigen binding proteins of the invention, in particularly when expressed on the surface of a cell, more particularly a yeast cell, show a significantly reduced detection with labelled similar peptide:MHC multimers, comprising a similar peptide selected from the group consisting of TMED9-001. CAT-001, DDX60L-001, LRRC70-001, PTPLB-001, HDAC5-001, VPS13B-002, ZNF318-001, CCDC51-001, IFT17-003, DIAPH1-004, FADS2-001, FRYL-003, GIMAP8-001, HSF1-001, KNT-001, MAU-001, MCM4-001, MPPE1-001, MYO18-002, PRR12-001, PTRF-003, RASGRP1-001, SMARCD1-001, TGM2-001, VAV1-1, VIM-009, FARSA-001, ALOX15B-003, FAM114A2-002, GPR56-002, IGHD-002, NOMAP-3-0972. NOMAP-3-1265, NOMAP-3-1408, NOMAP-3-1587, NOMAP-3-1768, NOMAP-5-0765, PDCD10-004, TSN-001, ARMC9-002, CLI-001, COPG1-001, COPS7A-001, EIF-009, EXT2-006, LMNA-001, PKM-005, PSMB3-002, RPL-007, SPATS2L-003, SYNE1-2, TGM2-002 and TPR-004, in particular selected from the group consisting of TMED9-001, CAT-001, DDX60L-001, LRRC70-001, PTPLB-001, HDAC5-001, VPS13B-002, ZNF318-001, CCDC51-001, IFT17-003, DIAPH1-004, FADS2-001, FRYL-003, GIMAP8-001, HSF1-001, KNT-001, MAU-001, MCM4-001, MPPE1-001, MYO1B-002, PRR12-001. PTRF-003. RASGRP1-001, SMARCD1-001, TGM2-001 and VAV1-001, more particularly IFT17-003 in a complex with MHC, compared to detection with PRAME-004 peptide:MHC multimers The antigen binding proteins of the present invention have a high safety profile.

"Safety profile" herein refers to the capacity to distinguish a tumor cell, in particular a PRAME-004:MHC complex presenting tumor cell, from a healthy cell. This capacity is often expressed by indication of the safety window.

The "safety window" or "therapeutic window" herein refers to a parameter that compares the concentration of a compound required to induce a certain degree of cytotoxicity, such as 10%, 50%, 90% or 100% of cytotoxicity, against tumor cells, in particular a PRAME-004:MHC complex presenting tumor cells, to the concentration required to induce cytotoxicity, preferably similar degree of cytotoxicity, more preferably the same degree of cytotoxicity, against healthy cells. For example, if the concentration of an antigen binding protein required to induce 90% cytotoxicity against the tumor cell line is 1 pM and the concentration required to induce 90% cytotoxicity against e.g. healthy cells is 1000 pM, the safety window is 1000 since the cytotoxic concentration required for the tumor cell line is 1000 times lower than the concentration required for the healthy cells.

In some embodiments, the safety window compares the concentration of a compound required for inducing half-maximal (50%) cytotoxicity ($EC_{50}$) against tumor cells to the concentration of a compound required for inducing half-maximal (50%) cytotoxicity ($EC_{50}$) against healthy cells. Consequently, if for an antigen binding protein the $EC_{50}$ for a tumor cell line is 1 pM and the $EC_{50}$ for e.g. healthy cells is 1000 pM, the safety window is 1000 since the $EC_{50}$ for the tumor cell line is 1000 times lower than for the healthy cells.

In preferred embodiments, the antigen binding protein of the invention is characterized by a safety window of $\geq 100$, $\geq 500$, $\geq 1000$, $\geq 2000$, $\geq 3000$, $\geq 4000$, $\geq 5000$, $\geq 6000$, $\geq 8000$, $\geq 10000$, such as between 500 and 10000, preferably between 1000 and 10000.

A "PRAME-004:MHC complex presenting cell" herein refers to a cell that presents on its surface the PRAME antigenic peptide in a complex with a MHC molecule, wherein the copy number of said PRAME-004:MHC complex can be determined with methods known to the skilled in the art. In preferred embodiments, the PRAME-004:MHC complex presenting cell is a tumor cell, wherein the tumor is preferably a cancer as defined herein below in the section 'Therapeutic methods and uses'. In the context of the present invention, the PRAME-004:MHC complex is over-presented on the cell surface of a PRAME-004:MHC complex presenting cell, compared to levels of said complex on the surface of cells in normal (healthy) tissue (also referred to as "healthy cells"). By "over-presented" is meant that the PRAME-004:MHC complex is present at a level at least 1.2-fold of the level present in healthy tissue; preferably at least 2-fold, and more preferably between 5-fold to 10-fold of the level present in healthy tissue or cells.

In one embodiment, the PRAME-004:MHC complex presenting cell has a PRAME-004:MHC complex copy number of more than 50, more than 80, more than 100, more than 120, more than 150, more than 300, more than 400, more than 600, more than 800, more than 1000, more than 1500, more than 2000, preferably a PRAME-004:MHC copy number of 50 to 2000, such as 80 to 2000, such as 100 to 2000, for example 120 to 2000.

"Copy number" herein refers to the number of PRAME-004:MHC complex as defined in the context of the present invention that are present on the cell surface of a cell, such as a PRAME-004:MHC presenting cell, for example a cancer cell, or a healthy cell. Copy numbers of a protein can be determined by a variety of art known methods including FACS analysis of diseased cells with fluorescently labelled antigen binding proteins.

"Healthy cells" or normal tissue cells herein refers to cells that are no tumor cells, preferably healthy cells herein refers to cells of the tissue surrounding PRAME-004:MHC presenting cells, in particular surrounding PRAME-004:MHC complex presenting tumor cells. However, in some cases also healthy cells might express and present on their surface the PRAME-004:MHC complex. Typically, in healthy cells in the context of the present invention, as it will be understood by the skilled in the art, the PRAME-004:MHC complex is present in lower amounts (copy numbers) than in a tumor cell. Accordingly, in one embodiment, the healthy cells have a PRAME-004:MHC complex copy number of less than 50, less than 20, less than 10, preferably less than 10 PRAME-004:MHC complex copy number, preferably a PRAME-004:MHC complex copy number between 0 and 10.

Healthy cells are preferably selected from the group consisting of astrocytes, GABAneurons, cardiomyocytes, cardiac microvascular endothelial cells, chondrocytes, aortic endothelial cells, coronary artery endothelial cells, dermal microvascular endothelial cells, mesenchymal stem cells, nasal epithelial cells, peripheral blood mononuclear cells, pulmonary artery smooth muscle cells, pulmonary fibroblasts, epidermal keratinocytes, renal cortical epithelial cells and tracheal smooth muscle cells, preferably astrocytes, in particular iPSC-derived astrocytes, cardiomyocytes, in particular iPSC-derived cardiomyocytes, aortic endothelial cells, mesenchymal stem cells and tracheal smooth muscle cells.

In one preferred embodiment, the concentration of the antigen binding protein of the invention required to achieve at least 90%, preferably 100% cytotoxicity in a tumor cell, in particular a PRAME-004:MHC complex presenting tumor cell, is at least 100, at least 500, at least 1000, at least 5000, or at least 10000 times lower than the concentration required to achieve at least 10%, at least 50%, at least 90% or 100% cytotoxicity In a healthy cell selected from the group consisting of astrocytes, GABAneurons, cardiomyocytes, cardiac microvascular endothelial cells, chondrocytes, aortic endothelial cells, coronary artery endothelial cells, dermal microvascular endothelial cells, mesenchymal stem cells, nasal epithelial cells, peripheral blood mononuclear cells, pulmonary artery smooth muscle cells, pulmonary fibroblasts, epidermal keratinocytes, renal cortical epithelial cells and tracheal smooth muscle cells, preferably astrocytes, in particular iPSC-derived astrocytes, cardiomyocytes, in particular iPSC-derived astrocytes, iPSC-derived cardiomyocytes, aortic endothelial cells, mesenchymal stem cells and tracheal smooth muscle cells.

The inventors demonstrated that the CDRs defined in the claims may be used in antigen binding proteins that have different formats. For example, in the experimental section the inventors used these CDRs in TCER® molecules and in single chain TCR constructs, such as a bispecific TCR comprising a scTCR fused to a Fab fragment (scTCR-Fab).

Accordingly, the skilled in the art understands from these experiments, that indeed the CDRs as herein described may be used in different antigen binding proteins of the invention.

In one embodiment, the epitope and binding characteristics are conserved when the format of an antigen binding protein is changed.

In some embodiments, the antigen binding protein is a TCR or an antibody. The skilled person is aware that in instances where the antigen binding protein is an antibody, this "antibody" comprises at least the TCR-derived CDR1, CDR3 and optionally CDR2 sequences as defined in the claims and thus is not a native or conventional antibody. However, an antigen binding protein comprising, for example, TCR-derived CDRs and antibody-derived framework regions and antibody derived constant domains, will have the overall structure of a conventional antibody and can be referred to as "antibody".

In some embodiments, the antigen binding protein is bispecific, in particular a bispecific TCR, a bispecific antibody or a bispecific TCR-antibody molecule. The skilled person is aware that in also in instances where the antigen binding protein is a bispecific "antibody", one of the antigen binding sites comprises the TCR-derived CDR1, CDR3 and optionally CDR2 sequences as defined in the claims, while the other antigen-binding site may be entirely antibody-derived.

In one embodiment, the antigen binding protein is of human origin, which is understood as being generated from a human antigen locus and therefore comprising human sequences, in particular, human TCR or antibody sequences.

In one embodiment, the antigen binding protein is characterized as affinity-maturated antigen binding protein, which is capable of specifically binding the PRAME-004 antigenic peptide, in particular the PRAME-004:MHC complex, with a higher affinity than the parental molecule, in particular TCR R11P3D3.

In some embodiments, the antigen binding protein comprises a first polypeptide chain comprising $V_A$ and a second polypeptide chain comprising $V_B$.

In some embodiments, the first and the second polypeptide, and thus $V_A$ and $V_B$ are located on a single polypeptide chain. Such a single chain construct may be a single chain TCR (scTCR), a single chain antibody, or a single chain bispecific antigen binding protein, in particular a single chain bispecific antibody, a single chain bispecific TCR, or a single chain bispecific TCR-antibody molecule. An example for a single chain TCR (scTCR) are the constructs used in example 1, which can also be referred to as single chain TCR variable domain ("scTv") molecules. An example for a single chain "antibody" would be a scFv in which the CDRs have been replaced by TCR-derived CDRs. An example for a single chain bispecific antibody would be a diabody in which one binding site is antibody-derived and the other binding site is TCR-derived or at least comprises TCR-derived CDRs. As discussed above, such a hybrid antigen binding protein may alternatively be referred to as single chain bispecific TCR or single chain bispecific TCR-antibody molecule.

Framework Regions

The inventors of the present invention furthermore discovered that specific mutations in the framework region of the antigen binding proteins compared to the parental TCR R11P3D3 have an advantageous effect.

In $V_A$, advantageous mutations are:

N20K, which removes a naturally occurring possible N-glycosylation site,

W44K, which improves pairing, affinity and stability, of the variable domains in combination with Q44E in $V_B$, and A52F, V55Y, K92T and G930, which increase the stability of the antigen binding protein.

In $V_B$, advantageous mutations are:

A84D, A84E, A840, A84N, A84S, preferably A84D, which increase affinity towards the peptide-MC complex, Q44E, which improves pairing, affinity and stability, of the variable domains in combination with W44K in $V_A$ and M46P and R48Q, which increase the stability of the antigen binding protein.

The mutations are indicated according to the IMGT nomenclature.

Accordingly, the antigen binding proteins of the invention preferably comprise one or more, preferably all of N20K, W44K, A52F, V55Y, K92T and G93D in $V_A$ (compared to $V_\alpha$ of R11P3D3) and one or more, preferably all of A84D, Q44E, M46P and R480 in $V_B$ (compared to $V_\beta$ of R11P3D3).

The antigen binding proteins of the invention may further comprise one or more of L2M, L391 and Q14K in $V_A$ (compared to $V_\alpha$ of R11P3D3) and one or more of E11L, E11K and R22H in $V_B$ (compared to $V_\beta$ of 811P3D3).

Accordingly, the antigen binding proteins of the invention preferably comprise one or more, preferably all of the following amino acids 20K, 44K, 52F, 55Y, 92T and 93D in $V_A$ and one or more, preferably all of 84D, 44E, 46P and 480 in $V_B$.

The antigen binding proteins of the invention may further comprise one or more of the following amino acids 2M, 391 and 14K in $V_A$ and one or more of 11L or 11K and 22H in $V_B$.

In one embodiment, $V_A$ further comprises one or more framework regions, preferably all framework regions, selected from the group consisting of FR1-a, FR2-a, FR3-a and FR4-a, wherein FR1-a comprises or consists of the amino acid sequence of SEQ ID NO: 345 or SEQ ID NO: 346, or an amino acid sequence at least 85%, 90% or 95% identical to SEQ ID NO: 345, preferably comprising K or N, more preferably K, at position 20 and/or L or M at position 2;

FR2-a comprises or consists of the amino acid sequence of SEQ ID NO: 347 or SEQ ID NO: 348, or an amino acid sequence at least 85%, 90% or 95% identical to SEQ ID NO: 347, preferably comprising L, I or M, more preferably L or I, at position 39, A or D, more preferably A, at position 47, K or W, preferably K, at position 44, F or A, preferably F, at position 52 and/or Y or V, preferably Y, at position 55;

FR3-a comprises or consists of the amino acid sequence of SEQ ID NO: 349 or an amino acid sequence at least 85%, 90% or 95% identical to SEQ ID NO: 349, preferably comprising T or K, preferably T, at position 92 and/or D or G, preferably D, at position 93;

FR4-a comprises or consists of the amino acid sequence of SEQ ID NO: 350 or an amino acid sequence at least 85%, 90% or 95% identical to SEQ ID NO: 350; and $V_B$ further comprises one or more framework regions, preferably all framework regions, selected from the group consisting of FR1-b, FR2-b, FR3-b and FR4-b, wherein FR1-b comprises or consists of the amino acid sequence of SEQ ID NO: 351 or SEQ ID NO: 352 or an amino acid sequence at least 85%, 90% or 95% identical to SEQ ID NO: 351, preferably comprising H or N, more preferably H, at position 10, E, L or K, preferably E, at position 11 and/or R or H, at position 22;

FR2-b comprises or consists of the amino acid sequence of SEQ ID NO: 353 or an amino acid sequence at least 85%, 90% or 95% identical to SEQ ID NO: 353, preferably comprising R or K, more preferably R, at position 43, E or Q, preferably E, at position 44. M or P, more preferably P, at position 46, and/or R or Q, more preferably Q, at position 48;

FR3-b comprises or consists of the amino acid sequence of SEQ ID NO: 354 or SEQ ID NO: 355 or an amino acid sequence at least 85%, 90% or 95% identical to SEQ ID NO: 354, preferably comprising D, A, E, R, K, Q, N or S, more preferably D, A, E, Q, N or S, more preferably D or A, even more preferably D, at position 84; and

FR4-b comprises or consists of the amino acid sequence of SEQ ID NO: 356 or an amino acid sequence at least 85%, 90% or 95% identical to SEQ ID NO: 356.

Variants of the antigen binding proteins as described herein are contemplated and explicitly referred to using the wording "at least 85% identical to a reference sequence" as defined herein above in the section definitions. For instance, the amino acid sequences of FR1-a, FR2-a, FR3-a, FR4-a, FR1-b, FR2-b, FR3-b and FR4-b may differ from the reference sequences SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, or SEQ ID NO: 356, as appropriate, by at least one amino acid substitution, in particular by at least one conservative amino acid substitution and/or substitution with canonical residues. In particular, the sequences FR1-a, FR2-a, FR3-a and FR4-a, FR1-b, FR2-b, FR3-b and FR4-b of $V_A$ and $V_B$ may differ from the reference sequences SEQ ID NO: 345, SEQ ID NO: 346, SEQ ID NO: 347, SEQ ID NO: 348, SEQ ID NO: 349. SEQ ID NO: 350, SEQ ID NO: 351, SEQ ID NO: 352, SEQ ID NO: 353, SEQ ID NO: 354, SEQ ID NO: 355, or SEQ ID NO: 356, as appropriate, by conservative amino acid substitutions only.

Modifications and changes may be made in the amino acid sequence of the antigen binding protein of the present invention, and in the corresponding DNA sequences, respectively, and still result in a functional antigen binding protein or polypeptide with desirable characteristics. Modifications may be made in $V_A$ and/or $V_B$, in particular in the framework regions or in the CDRs.

$V_A$ and $V_B$ preferably comprise at position 44 according to IMGT numbering amino acid substitutions compared to TCR R11P3D3. In embodiments in which the antigen binding protein is a TCR, these substitutions improve the pairing of the chains (i.e. pairing of α and β chains or paring of γ and δ). The amino acid present at position 44 in $V_A$ or $V_B$ may be substituted by an amino acid selected from the group consisting of Q, R, D, E, K, L, W, and V. Preferred are the substitutions W44K in $V_A$ and Q44E in $V_B$, which are present in SEQ ID NO: 347, SEQ ID NO: 348 (FR2-a) and SEQ ID NO: 353 (FR2-b), respectively, and which result in the amino acid pair $v_A$44K/$v_B$44E. Other suitable combinations are: $v_A$44Q/$v_B$440, $v_A$44D/$v_A$44R, $_{vA}$44R/$v_B$44D, $v_A$44E/$v_B$44K, $v_A$44D/$v_A$44K, $v_A$44K/$v_B$44D, $v_A$44R/$v_B$44E; $v_A$44E/$v_B$44R, $v_A$44L/$v_B$44W, $v_A$44W/$v_B$44L, $v_A$44W/$v_B$44W and $v_A$44W/$v_B$44V.

Additional substitutions and description may be found in U.S. Patent Application No. 2018-0162922, the contents of which are herein incorporated by reference in their entirety.

Variable Domains

In one embodiment, $V_A$ comprises or consists of the amino acid sequence of a TCR-derived variable domain comprised in a polypeptide of SEQ ID NO: 100, 103, 105, 106, 111, 122, 124, 126, 128, 151, 155, 156, 157, 158, 159, 166, 167, 169, 171, 173, 175, 177, 178, 179, 180, 181, 183, 189, 191, 193, 195, 197, 199, 201, 203, 205, 207, 209, 211, 213, 215, 217, 285, 291, 295, 299 or 303, and $V_B$ comprises or consists of the amino acid sequence of a TCR-derived variable domain comprised in a polypeptide of SEQ ID NO: 101, 102, 104, 107, 110, 119, 121, 131, 133, 143, 152, 153, 160, 161, 162, 163, 164, 165, 168, 170, 172, 174, 176, 182, 184, 185, 186, 216, 218, 220, 222, 224, 228, 230, 232, 234, 236, 238, 240, 242, 244, 246, 248, 250, 252, 254, 256, 258, 260, 262, 264, 266, 268, 270, 272, 274, 276, 278, 282, 284, 296 or 300. The skilled in the art is entirely capable to distinguish the amino acid sequence of the TCR-derived variable domains within the polypeptide sequences of the above-mentioned SEQ ID NOs.

In one embodiment, $V_A$ comprises or consists of the amino acid sequence of SEQ ID NO: 132 or an amino acid sequence at least 85%, 90% or 95% identical to SEQ ID NO: 132, preferably comprising a CDRa1 of SEQ ID NO: 16, a CDRa2 of SEQ ID NO: 32 and a CDRa3 of SEQ ID NO: 33, SEQ ID NO: 34, or SEQ ID NO: 9, and further optionally comprising K or N, preferably K, at position 20, L, M, or I, preferably L or I, at position 39, K or W, preferably K, at position 44, F or A, preferably F, at position 52, Y or V, preferably Y, at position 55, T or K, preferably T, at position 92 and/or D or G, preferably D, at position 93; and $V_B$ comprises or consists of the amino acid sequence of SEQ ID NO: 134 or an amino acid sequence at least 85%, 90% or 95% identical to SEQ ID NO:134, preferably comprising a CDRb1 of SEQ ID NO: 10, a CDRb2 of SEQ ID NO: 36, and a CDRb3 of SEQ ID NO: 48, SEQ ID NO: 49, SEQ ID NO: 47, SEQ ID NO: 281, SEQ ID NO: 292, SEQ ID NO: 294, SEQ ID NO: 297, SEQ ID NO: 298, SEQ ID NO: 301 or SEQ ID NO: 283, and further optionally comprising E, L or K, preferably E, at position 11, R or H at position 22, E or Q, preferably E, at position 44, P or M, preferably P, at position 46, Q or R, preferably Q, at position 48 and/or D, A, E, R, K Q, N or S, more preferably Q, A, E, Q, N or S, preferably D or A, at position 84.

It is preferred that $V_A$ comprises or consists of the amino acid sequence of SEQ ID NO: 132 or an amino acid sequence at least 85%, 90% or 95% identical to SEQ ID NO: 132, comprising a CDRa1 of SEQ ID NO: 16, a CDRa2 of SEQ ID NO: 32 and a CDRa3 of SEQ ID NO: 33, SEQ ID NO: 34, or SEQ ID NO: 9, and further optionally comprising K or N, preferably K, at position 20, L, M, or I, preferably L or I, at position 39, K or W, preferably K, at position 44, F or A, preferably F, at position 52, Y or V, preferably Y, at position 55, T or K, preferably T, at position 92 and/or D or G, preferably D, at position 93; and $V_B$ comprises or consists of the amino acid sequence of SEQ ID NO: 134 or an amino acid sequence at least 85%, 90% or 95% identical to SEQ ID NO: 134, comprising a CDRb1 of SEQ ID NO: 10, a CDRb2 of SEQ ID NO: 36, and a CDRb3 of SEQ ID NO: 48, SEQ ID NO: 49, SEQ ID NO: 47, SEQ ID NO: 281, SEQ ID NO: 292, SEQ ID NO: 294, SEQ ID NO: 297, SEQ ID NO: 298, SEQ ID NO: 301 or SEQ ID NO: 283, and further optionally comprising E, L or K, preferably E, at position 11. R or H at position 22, E or Q, preferably E, at position 44, P or M, preferably P, at position 46, Q or R, preferably Q, at position 48 and/or D, A, E, R, K, Q, N, or S, preferably D, A, E, Q, N or S, more preferably D or A, at position 84.

In preferred embodiments, $V_A$ comprises or consists of the amino acid sequence of SEQ ID NO: 132, SEQ ID NO: 129, SEQ ID NO: 137 or SEQ ID NO: 142, and $V_B$ comprises or consists of the amino acid sequence of SEQ ID NO: 134, SEQ ID NO:130, SEQ ID NO:135 SEQ ID NO:136, SEQ ID NO:138, SEQ ID NO:139, SEQ ID NO: 140, SEQ ID NO: 141, SEQ ID NO: 144, SEQ ID NO: 145, SEQ ID NO: 146, SEQ ID NO: 147 or SEQ ID NO: 148.

It is particularly preferred that $V_A$ comprises or consists of the amino acid sequence of SEQ ID NO: 132 and $V_B$ comprises or consists of the amino add sequence of SEQ ID NO: 134;

$V_A$ comprises or consists of the amino acid sequence of SEQ ID NO: 132 and $V_B$ comprises or consists of the amino acid sequence of SEQ ID NO: 135;

$V_A$ comprises or consists of the amino acid sequence of SEQ ID NO: 132 and $V_B$ comprises or consists of the amino acid sequence of SEQ ID NO: 140;

$V_A$ comprises or consists of the amino acid sequence of SEQ ID NO: 132 and $V_B$ comprises or consists of the amino acid sequence of SEQ ID NO: 136;

$V_A$ comprises or consists of the amino acid sequence of SEQ ID NO: 137 and $V_B$ comprises or consists of the amino acid sequence of SEQ ID NO: 134;

$V_A$ comprises or consists of the amino acid sequence of SEQ ID NO: 137 and $V_B$ comprises or consists of the amino acid sequence of SEQ ID NO: 135; or $V_A$ comprises or consists of the amino acid sequence of SEQ ID NO: 137 and $V_B$ comprises or consists of the amino acid sequence of SEQ ID NO: 134.

Most preferably, $V_A$ comprises or consists of the amino acid sequence of SEQ ID NO: 132 and $V_B$ comprises or consists of the amino acid sequence of SEQ ID NO: 134, 135 or 140, in particular SEQ ID NO:135. Thus, $V_A$ may comprise or consist of the amino acid sequence of SEQ ID NO: 132 and $V_B$ may comprise or consists of the amino acid sequence of SEQ ID NO:135. Alternatively, $V_A$ may comprise or consist of the amino acid sequence of SEQ ID NO: 132 and $V_B$ may comprise or consist of the amino acid sequence of SEQ ID NO: 140.

Variants of the antigen binding proteins as described herein are contemplated and explicitly referred to using the wording "at least 85% identical to a reference sequence" as defined herein above in the section definitions. For instance, the sequences of $V_A$ and $V_B$ may differ from the reference sequences of SEQ ID NO: 132 and SEQ ID NO: 134, respectively, by at least one amino acid substitution, in particular by at least one conservative amino acid substitution and/or substitution with canonical residues. In particular, the sequences of $V_A$ and $V_B$ may differ from the reference sequences of SEQ ID NO: 132 and SEQ ID NO: 134, respectively, by conservative amino acid substitutions only.

Modifications and changes may be made in the amino acid sequence of the antigen binding protein of the present invention, and in the corresponding DNA sequences, respectively, and still result in a functional antigen binding protein or polypeptide with desirable characteristics.

In one embodiment, the antigen binding protein of the invention further comprises one or more of the following:

(i) one or more further antigen binding sites;

(ii) a transmembrane region, optionally including a cytoplasmic signalling region;

(iii) a diagnostic agent;

(iv) a therapeutic agent; or (v) a PK modifying moiety.

In instances where the above-listed elements (i) to (v) are polypeptides fused to the antigen binding protein of the invention, the antigen binding proteins can also be referred to as "TCR fusion proteins".

The further antigen binding site is preferably antibody-derived.

A "transmembrane region", in the context of the present invention may be, for example, a TCR alpha or beta transmembrane domain.

A "cytoplasmic signaling region" may be for example a TCR alpha or beta intracellular domain.

A "diagnostic agent" herein refers to a detectable molecule or substance, such as a fluorescent molecule, a radioactive molecule or any other labels known in the art that provide (either directly or indirectly) a signal.

"Fluorescent molecules" are known in the art include fluorescein isothiocyanate (FITC), phycoerythrin (PE), fluorophores for use in the blue laser (e.g. PerCP, PE-Cy7, PE-Cy5, FL3 and APC or Cy5, FL4), fluorophores for use in the red, violet or UV laser (e.g. Pacific blue, pacific orange).

"Radioactive molecules" include but are not limited radioactive atom for scintigraphic studies such as $I^{123}$, $I^{124}$, $In^{111}$, $Re^{186}$, $Re^{188}$, $Tc^{99}$. Antigen binding proteins of the invention may also comprise a spin label for nuclear magnetic resonance (NMR) imaging (also known as magnetic resonance imaging, MRI), such as iodine-123, indium-111, fluorine-19, carbon-13, nitrogen-15, oxygen-17, gadolinium, manganese or iron.

Such diagnostic agents are may be either directly coupled (i.e., physically linked) to the antigen binding protein or may be indirectly linked.

A "therapeutic agent" herein refers to an agent that has a therapeutic effect. The terms therapeutic agent and drug are used interchangeably herein. In one embodiment, a therapeutic agent may be a growth inhibitory agent, such as a cytotoxic agent or a radioactive isotope.

A "growth inhibitory agent", or "anti-proliferative agent", which can be used indifferently, refers to a compound or composition which inhibits growth of a cell, especially a tumour cell, either in vitro or in vivo.

The term "cytotoxic agent" as used herein refers to a substance that inhibits or prevents the function of cells and/or causes destruction of cells. The term "cytotoxic agent" is intended to include chemotherapeutic agents, enzymes, antibiotics, and toxins such as small molecule toxins or enzymatically active toxins of bacterial, fungal, plant or animal origin, including fragments and/or variants thereof, and the various antitumor or anticancer agents disclosed below. In some embodiments, the cytotoxic agent is a taxoid, vincas, taxanes, a maytansinoid or maytansinoid analog such as DM1 or DM4, a small drug, a tomaymycin or pyrrolobenzodiazepine derivative, a cryptophycin derivative, a leptomycin derivative, an auristatin or dolastatin analog, a prodrug, topoisomerase II inhibitors, a DNA alkylating agent, an anti-tubulin agent, a CC-1065 or CC-1065 analog.

The term "radioactive isotope" is intended to include radioactive isotopes suitable for treating cancer, such as $At^{211}$, $Bi^{212}$, $Er^{169}$, $I^{131}$, $I^{125}$, $Y^{90}$, $In^{111}$, $P^{32}$, $Re^{186}$, $Re^{188}$, $Sm^{153}$, $Sr^{89}$, and radioactive isotopes of Lu. Such radioisotopes generally emit mainly beta-radiation. In an embodiment the radioactive isotope is alpha-emitter isotope, more precisely Thorium 227 which emits alpha-radiation.

In some embodiments, the antigen binding proteins of the present invention are covalently attached, directly or via a cleavable or non-cleavable linker, to the at least one growth inhibitory agent. An antigen binding protein to which such the at least one growth inhibitory agent is attached may also be referred to as a conjugate. A cleavable linker facilitates release of the cytotoxic agent or growth inhibitory agent from the antigen binding protein in the cell. For example, an acid-labile linker, a peptidase-sensitive linker, an esterase labile linker, a photolabile linker or a disulfide-containing linker (See e.g. U.S. Pat. No. 5,208,020) may be used. The linker may be also a "non-cleavable linker" (for example SMCC linker) that might lead to better tolerance in some cases.

The preparation of such conjugates, for example immunoconjugates, is described in the application WO2004/091668 or Hudecz, F., Methods Mol. Biol. 298: 209-223 (2005) and Kirin et al, Inorg Chem. 44(15): 5405-5415 (2005), the contents of which are herein incorporated by reference in their entireties, and may by the skilled in the art be transferred to the preparation of antigen binding proteins of the present invention to which such a at least one growth inhibitory agent is attached.

Alternatively, a fusion protein comprising the antigen binding protein of the invention and a cytotoxic or growth inhibitory polypeptide may be made, by recombinant techniques or peptide synthesis. The length of DNA may comprise respective regions encoding the two portions of the conjugate either adjacent one another or separated by a region encoding a linker peptide which does not destroy the desired properties of the conjugate.

The antigen binding proteins of the present invention may also be used in Dependent Enzyme Mediated Prodrug Therapy by conjugating the polypeptide to a prodrug-activating enzyme which converts a prodrug (e.g. a peptidyl chemotherapeutic agent, see WO 81/01145) to an active anti-cancer drug (See, for example, WO 88/07378 and U.S. Pat. No. 4,975,278).

A "PK modifying moiety" herein refers to a moiety that modifies the pharmacokinetics of the antigen binding protein of the invention. Accordingly, the moiety modifies in particular the in vivo half-life and distribution of the antigen binding protein of the invention. In a preferred embodiment, the PK modifying moiety increases the half-life of the antigen binding protein. Examples of PK modifying moieties include, but are not limited to, PEG (Dozier et at, (2015) Int J Mol Sci. October 28; 16(10):25831-64 and Jevsevar et al., (2010) Biotechnol J. January; 5(1):113-28), PASylation (Schlapschy et al., (2013) Protein Eng Des Sel. August; 26(8):489-501), albumin (Dennis et al., (2002) J Biol Chem. September 20; 277(38):35035-43), the $F_c$-part of an antibody and/or unstructured polypeptides (Schellenberger et at, (2009) Nat Biotechnol. December; 27(12):1186-90).

In one embodiment, the antigen binding protein of the invention further comprises one or more of the following: an enzyme, a cytokine (such as the human IL-2, IL-7 or IL-15), a nanocarrier, or a nucleic acid.

$2^{nd}$ Antigen Binding Site

In preferred embodiments, the antigen binding protein further comprises an antibody light chain variable domain ($V_L$) and an antibody heavy chain variable domain ($V_H$). The variable domain $V_L$ and the variable domain $V_H$ together form an antigen binding site. Hereinafter, this antigen binding site is sometimes also referred to "second antigen binding site". The antigen binding site formed by $V_L$ and $V_H$ preferably binds to an antigen of an effector cell, can also be referred to as "recruiter", as it recruits an effector cell to a tumor. In the context of the present invention, "effector cell" refers to a T cell or natural killer cell (NK cell).

In preferred embodiments, $V_L$ and $V_H$ bind to an antigen selected from the group consisting of CD2, CD3 (such as the CD3γ, CD3δ, and CD3ε chains), CD4, CD5, CD7, CD8, CD10, CD11b, CD11c, CD14, CD16, CD18, CD22, CD25, CD28, CD32a, CD32b, CD33, CD41, CD41b, CD42a, CD42b, CD44, CD45RA, CD49, CD55, CD56, CD61, CD64, CD68, CD90, CD94, CD95, CD117, CD123, CD125, CD134, CD137, CD152, CD163, CD193, CD203c, CD235a, CD278, CD279, CD287, Nkp46, NKG2D, GITR, $F_c$εRI, TCRα/β, TCRγ/δ, HLA-DR and 4-1 BB, or combinations thereof and/or $V_L$ and $V_H$ bind to an effector cell.

"Combinations thereof" refers to complexes of two or more of said antigens, e.g. a TCRα/β CD3 complex. Preferably, the antigen is CD3, a TCRα/β CD3 complex or CD28, more preferably CD3, or a TCRα/β CD3 complex.

For targeting of the TCR-CD3 complex, $V_H$ and $V_L$ domains derived from the CD3-specific, humanized antibody hUCHT1 (Zhu et al., Identification of heavy chain residues in a humanized anti-CD3 antibody important for efficient antigen binding and T cell activation. J Immunol, 1995, 155, 1903-1910) can be used, in particular $V_H$ and $V_L$ domains derived from the UCHT1 variants UCHT1-V17, UCHT1-V17opt, UCHT1-V21 or UCHT1-V23, preferably derived from UCHT1-V17, more preferably a $V_H$ comprising or consisting of SEQ ID NO: 109 and a $V_L$ comprising or consisting of SEQ ID NO:108. Alternatively, $V_H$ and $V_L$ domains derived from the antibody BMA031, which targets the TCRα/β CD3 complex, and humanized versions thereof (Shearman et al., Construction, expression and characterization of humanized antibodies directed against the human alpha/beta T cell receptor, J Immunol, 1991, 147, 4366-73) may be used, in particular $V_H$ and $V_L$ domains derived from BMA031 variants BMA031 (V36) or BMA031 (V10), preferably derived from BMA031 (V36), more preferably a $V_H$ comprising or consisting of SEQ ID NO: 112 or SEQ ID NO: 114 (A02) or SEQ ID NO: 115 (D01) or SEQ ID NO: 116 (A02_H90Y) or SEQ ID NO: 117 (D01_H90Y), and a $V_L$, comprising or consisting of SEQ ID NO:113. As another alternative, $V_H$ and $V_L$ domains derived from the CD3ε-specific antibody H2C (described in EP2 1 55 783) may be used, in particular a $V_H$ comprising or consisting of SEQ ID NO: 118 or SEQ ID NO: 123 (N1000) or SEQ ID NO: 125 (N100E) or SEQ ID NO: 127 (S101A) and a $V_L$ comprising or consisting of SEQ ID NO:120. All positions and CDR definitions are according to Kabat numbering scheme.

In some embodiments, $V_H$ and $V_L$ together bind to the TCRα/β CD3 complex and $V_H$ comprises
- a heavy chain complementarity determining region 1 (HCDR1) comprising the amino acid sequence of SEQ ID NO: 381 (SYVMH),
- a HCDR2 comprising the amino acid sequence of YINPYNDVTKYX₁X₂KFX₃G (SEQ ID NO: 382), wherein $X_1$ is A or N; $X_2$ is E or Q; and/or $X_3$ is Q or K a HCDR3, and
- heavy chain framework regions (HFR) 1-4; and $V_L$ comprises
- a light chain complementarity determining region 1 (LCDR1) comprising the amino acid sequence of SEQ ID NO: 383 (SATSSVSYMH),
- a LCDR2 comprising the amino acid sequence of SEQ ID NO: 384 (DTSKLAS) and
- a LCDR3,
wherein
- at least one amino acid of HCDR1 comprising the amino acid sequence of SEQ ID NOs: 1 and/or least one amino acid of HCDR2 comprising the amino acid sequence of SEQ ID NO: 2 that is not positively charged is substituted with a positively charged amino acid; and/or
- at least one amino acid of LCDR1 comprising the amino acid sequence of SEQ ID NO: 3 and/or at least one amino acid of LCDR2 comprising the amino acid sequence of SEQ ID NO: 4 that is not positively charged is substituted with a positively charged amino acid; and/or
- HFR3 comprises a tyrosine (Y) residue at position 90 according to Kabat numbering.

Preferably, the antigen binding polypeptide comprises the positively charged amino acid in the heavy chain:
- at position 31 is R, K or H;
- at position 53 is R, K or H; and/or
- at position 54 is R or K; and/or
the positively charged amino acid in the light chain
- at position 31 is R or K; and/or
- at position 56 is R or K.

In some embodiments, $V_H$ comprises a sequence selected from the group consisting of: SEQ ID NOs: 112, 114 to 117 and 366 to 376 and $V_L$ comprises a sequence selected from the group consisting of: SEQ ID NOs: 113 and 377 to 380. Preferably, $V_H$ comprises or consists of the amino acid sequence of SEQ ID NO: 112 or 114 to 117 and $V_L$ comprises or consists of the amino acid sequence of SEQ ID NO: 113 or 378, preferably 113.

"CD28" is expressed on T cells and can provide co-stimulatory signals, which are required for T cell activation. CD28 plays important roles in T cell proliferation and survival, cytokine production, and T-helper type-2 development.

"CD134" is also termed Ox40, CD134/OX40 is expressed after 24 to 72 hours following activation and can be taken to define a secondary costimulatory molecule.

"4-1 BB" is capable of binding to 4-1 BB-Ligand on antigen presenting cells (APCs), whereby a costimulatory signal for the T cell is generated.

"CD5" is another example of a receptor predominantly found on T cells, CD5 is also found on B cells at low levels.

"CD95" is a further example of a receptor modifying T cell functions and is also known as the Fas-receptor, which mediates apoptotic signaling by Fas-ligand expressed on the surface of other cells. CD95 has been reported to modulate TCR/CD3-driven signaling pathways in resting T lymphocytes.

A "NK cell specific receptor molecule" is, for example, CD16, a low affinity $F_c$ receptor and NKG2D.

An example of a receptor molecule that is present on the surface of both T cells and natural killer (NK) cells is CD2 and further members of the CD2-superfamily. CD2 is able to act as a co-stimulatory molecule on T and NK cells.

Bispecific and Multispecific Antigen Binding Proteins

Accordingly, the antigen binding proteins of the invention preferably comprise $V_A$ and $V_B$, which form a first antigen binding site specific for the PRAME-004:MHC complex and $V_L$ and $V_H$, which form a second antigen binding site capable of binding to effector cells, preferably T cells. $V_A$, $V_B$, $V_L$ and $V_H$ may be located on a single polypeptide chain or on several polypeptide chains, preferably two polypeptide chains. Further to $V_A$, $V_B$, $V_L$ and $V_H$, the antigen binding proteins of the invention may or may not comprise dimerization domains, preferably constant immunoglobulin domains.

In some embodiments, $V_A$, $V_B$, $V_L$ and $V_H$ are located on two polypeptide chains. Preferably, each polypeptide chain comprises two variable domains. It is preferred that one polypeptide chain comprises $V_A$ and the other polypeptide chain comprises $V_B$. Preferably, the polypeptide chain comprising $V_A$ comprises one of $V_L$ and $V_H$, and the polypeptide chain comprising $V_B$ comprises the other of $V_L$ and $V_H$. It is also possible that the polypeptide chain comprising $V_A$ comprises both $V_L$ and $V_H$, and the polypeptide chain comprising $V_B$ comprises none of $V_L$ and $V_H$, or vice versa. Another possibility is that one polypeptide chain comprises $V_A$, one polypeptide chain comprises $V_B$, and a third polypeptide chain comprises $V_L$ and $V_H$.

In preferred embodiments, the antigen binding protein comprises a first and a second polypeptide chain, wherein the first polypeptide chain is represented by formula [Ia]:

$$V_1\text{-}L_1\text{-}D_1\text{-}L_2\text{-}V_2\text{-}L_3\text{-}D_2 \qquad \text{[Ia]},$$

and the second polypeptide chain is represented by formula [IIa]

$$V_3\text{-}L_4\text{-}D_3\text{-}L_3\text{-}V_4\text{-}L_6\text{-}D_4 \qquad \text{[IIa]},$$

wherein $V_1$, $V_2$, $V_3$, and $V_4$ are variable domains, wherein one is $V_A$, one of $V_1$ to $V_4$ is $V_B$, one is $V_L$ and one is $V_H$;

$D_1$, $D_2$, $D_3$, and $D_4$ are dimerization domains and may be present or absent, wherein $D_1$ and $D_3$, and $D_2$ and $D_4$, specifically bind to each other and at least one pair of $D_1$ and $D_3$, or $D_2$ and $D_4$ is present; and $L_1$, $L_2$, $L_3$, $L_4$, $L_5$, and $L_6$ are linkers, wherein $L_1$ and $L_4$ are present and $L_2$, $L_3$, $L_5$, and $L_6$ may be present or absent.

It is preferred that one of $V_1$ and $V_2$ is $V_A$, one of $V_3$ and $V_4$ is $V_B$ and of the remaining two variable domains one is $V_L$ and the other is $V_H$, in other words. $V_A$ and $V_B$ are located on different polypeptide chains and $V_L$ and $V_H$ are located on different polypeptide chains.

The dimerization domains are preferably heterodimerization domains that mediate heterodimerization of a first polypeptide chain with a second polypeptide chain, but not homodimerization of two first or two second polypeptide chains. In preferred embodiments, a pair of dimerization domains (e.g. $D_1$ and $D_3$, and/or $D_2$ and $D_4$) comprises immunoglobulin constant domains, such as antibody-derived $C_L$ and $C_{H1}$, or $C_L$-$F_c$ and $C_{H1}$-$F_c$, or TCR-derived $C_\alpha$ and $C_\beta$, or a pair of $C_{H3}$ domains or a pair of $F_c$ domains, wherein the $C_{H3}$ and $F_c$ domains preferably comprise introduced mutations that force heterodimerization, such as knob-into-hole mutations.

In an even more preferred embodiment, the antigen binding protein comprises a first and a second polypeptide chain, wherein the first polypeptide chain is represented by formula [Ib]:

$$V_1\text{-}L_1\text{-}V_2\text{-}L_3\text{-}D_2 \qquad \text{[Ib]},$$

and the second polypeptide chain is represented by formula [IIb]:

$$V_3\text{-}L_4\text{-}V4\text{-}L_6\text{-}D_4 \qquad \text{[IIb]},$$

wherein $V_1$, $V_2$, $V_3$, $V_4$, are variable domains, wherein one is $V_A$, one is $V_B$, one is $V_L$ and one is $V_H$;

$D_2$ and $D_4$ are dimerization domains specifically binding to each other, preferably Fe domains; and $L_1$, $L_3$, $L_4$ and $L_6$ are linkers, wherein $L_3$, and $L_6$ may be present or absent.

As described with respect to formulae Ia and Ha, it is preferred that $V_A$ and $V_B$ are located on different polypeptide chains and $V_L$ and $V_H$ are located on different polypeptide chains, and that the dimerization domains are heterodimerization domains.

In preferred embodiments, $D_2$ and $D_4$ are a pair of F, domains $F_{c1}$ and $F_{c2}$, in particular $D_2$ is $F_{c1}$ and $D_4$ is $F_{c2}$, wherein $F_{c1}$ and $F_{c2}$ are the same or different, preferably different, and preferably comprise mutations that force het-erodimerization. In one embodiment. $F_{c1}$ comprises or consists of the amino acid sequence SEQ ID NO: 150 (hole) and $F_{c2}$ comprises or consists of the amino acid sequence SEQ ID NO: 149 (knob), or vice versa. In particular, when $F_{c1}$ is located on the polypeptide chain comprising $V_L$ and $F_{c2}$ is located on the polypeptide chain comprising $V_H$, $F_{c1}$ comprises or consists of the amino acid sequence SEQ ID NO:

149 (knob) and $F_{c2}$ comprises or consists of the amino acid sequence SEQ ID NO: 150 (hole), and when $F_{c1}$ is located on the polypeptide chain comprising $V_H$ and $F_{c2}$ is located on the polypeptide chain comprising $V_L$, $F_{c1}$ comprises or consists of the amino acid sequence SEQ ID NO:150 (hole) and $F_{c2}$ comprises or consists of the amino acid sequence SEQ ID NO: 149 (knob).

It is understood by the skilled in the art, that in antigen binding proteins comprising a first and a second polypeptide chain represented by formulae Ia and IIa or Ib and IIb, respectively, $V_A$ and $V_B$, and $V_L$ and $V_H$ may be in a parallel orientation as in the DVD format, or in a crossover orientation as in the CODV format.

In formulae Ia and IIa or Ib and IIb, $V_A$, $V_B$, $V_L$ and $V_H$ may have the following orientation:

(1) $V_1$ is $V_H$, $V_2$ is $V_B$, $V_3$ is $V_A$, and $V_4$ is $V_L$;

(2) $V_1$ is $V_B$, $V_2$ is $V_H$, $V_3$ is $V_L$; and $V_4$ is $V_A$;

(3) $V_1$ is $V_B$, $V_2$ is $V_B$, $V_3$ is $V_H$, and $V_4$ is $V_A$;

(4) $V_1$ is $V_L$, $V_2$ is $V_B$, $V_3$ is $V_A$, and $V_4$ is $V_H$;

(5) $V_1$ is $V_H$, $V_2$ is $V_B$, $V_3$ is $V_H$, and $V_4$ is $V_A$;

(6) $V_1$ is $V_B$, $V_2$ is $V_H$; $V_3$ is $V_A$, and $V_4$ is $V_L$;

(7) $V_1$ is $V_H$, $V_2$ is $V_B$, $V_3$ is $V_H$, and $V_4$ is $V_A$;

(8) $V_1$ is $V_B$, $V_2$ is $V_L$, $V_3$ is $V_A$, and $V_4$ is $V_H$;

(9) $V_1$ is $V_H$, $V_2$ is $V_L$, $V_3$ is $V_A$, and $V_4$ is $V_B$;

(10) $V_1$ is $V_L$, $V_2$ is $V_H$, $V_3$ is $V_A$, and $V_4$ is $V_B$;

(11) $V_1$ is $V_H$, $V_2$ is $V_L$, $V_3$ is $V_B$, and $V_4$ is $V_A$; or

(12) $V_1$ is $V_1$, $V_2$ is $V_H$, $V_3$ is $V_B$, and $V_4$ is $V_A$.

It is preferred that $V_A$, $V_B$, $V_L$ and $V_H$ have the orientation described in (1)-(8), i.e. $V_A$ and $V_B$ are located on different polypeptide chains and $V_L$ and $V_H$ are located on different polypeptide chains. More preferably, $V_A$, $V_B$, $V_L$ and $V_H$ have the orientation described in (1) (4), i.e. $V_A$ and $V_B$, and $V_L$ and $V_H$ are have a crossover orientation.

The linkers $L_1$, $L_2$, $L_3$, $L_4$, $L_5$ are defined herein above in the section 'definitions.' In some embodiments, certain linker lengths might be preferable for a specific format. However, the knowledge concerning linker lengths and their amino acid sequences belongs to the general knowledge of the art, and linkers as well as linker an amino acid sequences for the different formats are part of the state of the art and are disclosed in the here above cited disclosures.

It is particularly preferred that the antigen binding proteins of the invention are in the TCER® format. In embodiments of the TCER® format, the antigen binding protein comprises a first polypeptide chain and a second polypeptide chain represented by formula [IIa] and [IIb] as defined above, wherein $V_1$ is $V_H$, $V_2$ is $V_B$, $V_3$ is $V_A$, and $V_4$ is $V_L$;

$V_1$ is $V_B$, $V_2$ is $V_H$, $V_3$ is $V_L$; and $V_4$ is $V_A$;

$V_1$ is $V_B$, $V_2$ is $V_L$, $V_3$ is $V_H$, and $V_4$ is $V_A$; or $V_1$ is $V_L$, $V_2$ is $V_B$, $V_3$ is $V_A$, and $V_4$ is $V_H$;

$L_3$ and $L_6$ are absent;

$L_1$ and $L_4$ preferably comprise or consist of the amino acid sequence of SEQ ID NO: 214; and $D_2$ and $D_4$ are a pair of $F_c$ domains $F_{c1}$ and $F_{c2}$, wherein $F_{c1}$ and $F_{c2}$ are different and comprise a mutation that forces heterodimerization, preferably a "knob-into-hole" mutation.

In preferred embodiments, $V_L$ comprises or consists of the amino acid sequence SEQ ID NO: 108 and $V_H$ comprises or consists of the amino acid sequence SEQ ID NO: 109, or $V_L$ comprises or consists of the amino acid sequence SEQ ID NO: 113 and $V_H$ comprises or consists of the amino acid sequence SEQ ID NO: 112, SEQ ID NO: 114, SEQ ID NO: 115, SEQ ID NO: 116, or SEQ ID NO: 117 or $V_L$ comprises or consists of the amino acid sequence SEQ ID NO: 120 and $V_H$ comprises or consists of the amino acid sequence SEQ ID NO: 118, SEQ ID NO: 123, SEQ ID NO: 125, or SEQ ID NO: 127.

In particularly preferred embodiments, the antigen binding protein comprises a first polypeptide chain selected from SEQ ID NO: 100, 103, 105, 106, 111, 122, 126, 128, 151, 155, 156, 157, 158, 159, 166, 167, 169, 171, 173, 175, 177, 178, 179, 180, 181, 183, 189, 191, 193, 195, 197, 199, 201, 203, 205, 207, 209, 211, 213, 215, 217, 285, 291, 295, 299 and 303 and a second polypeptide chain selected from SEQ ID NO: 101, 102, 104, 107, 110, 119, 121, 131, 133, 143, 152, 160, 161, 162, 163, 164, 165, 168, 170, 172, 174, 176, 182, 184, 185,186, 216, 218, 220, 222, 224, 228, 230, 232, 234, 236, 238, 240, 242, 244, 246, 248, 250, 252, 254, 256, 258, 260, 262, 264, 266, 268, 270, 272, 274, 276, 278, 282, 284, 296 or 300.

In even more preferred embodiments, the antigen binding protein comprises a first polypeptide chain selected from SEQ ID NO: 100, 103, 105, 151, 156, 158, 166, 167, 175, 178, 180, 183, 193, 285, 291, 295, 299 and 303, more preferably selected from SEQ ID NO: 100, 103, 105, 167, 183, 193, 285, 291, 295, 299 and 303 and a second polypeptide chain selected from SEQ ID NO: 101, 102, 104, 160, 161, 162, 163, 164, 165, 170, 172, 174, 176, 182, 185, 186, 284, 296 or 300, more preferably selected from SEQ ID NO: 101, 102, 104, 160, 162, 176, 186, 284, 296 or 300.

In most preferred embodiments, the antigen binding protein comprises a first polypeptide chain of SEQ ID NO: 100 and a second polypeptide chain of SEQ ID NO: 101, or
a first polypeptide chain of SEQ ID NO: 103 and a second polypeptide chain of SEQ ID NO: 102, or
a first polypeptide chain of SEQ ID NO: 105 and a second polypeptide chain of SEQ ID NO: 104, or
a first polypeptide chain of SEQ ID NO: 167 and a second polypeptide chain of SEQ ID NO: 160, or
a first polypeptide chain of SEQ ID NO: 183 and a second polypeptide chain of SEQ ID NO: 176, or
a first polypeptide chain of SEQ ID NO: 193 and a second polypeptide chain of SEQ ID NO: 186, or
a first polypeptide chain of SEQ ID NO: 285 and a second polypeptide chain of SEQ ID NO: 284, or
a first polypeptide chain of SEQ ID NO: 291 and a second polypeptide chain of SEQ ID NO: 284, or
a first polypeptide chain of SEQ ID NO: 295 and a second polypeptide chain of SEQ ID NO: 186, or
a first polypeptide chain of SEQ ID NO: 295 and a second polypeptide chain of SEQ ID NO: 296, or
a first polypeptide chain of SEQ ID NO: 299 and a second polypeptide chain of SEQ ID NO: 162, or
a first polypeptide chain of SEQ ID NO: 285 and a second polypeptide chain of SE) ID NO: 300, or
a first polypeptide chain of SEQ ID NO: 303 and a second polypeptide chain of SEQ ID NO: 162, or
a first polypeptide chain of SEQ ID NO: 291 and a second polypeptide chain of SEQ ID NO: 300, or
a first polypeptide chain of SEQ ID NO: 151 and a second polypeptide chain of SEQ ID NO: 284, or
a first polypeptide chain of SEQ ID NO: 156 and a second polypeptide chain of SEQ ID NO: 162, or
a first polypeptide chain of SEQ ID NO: 158 and a second polypeptide chain of SEQ ID NO: 284, or
a first polypeptide chain of SEQ ID NO: 158 and a second polypeptide chain of SEQ ID NO: 300, or
a first polypeptide chain of SEQ ID NO: 303 and a second polypeptide chain of SEQ ID NO: 161, or a first polypeptide chain of SEQ ID NO: 303 and a second polypeptide chain of SEQ ID NO: 163, or
a first polypeptide chain of SEQ ID NO: 291 and a second polypeptide chain of SEQ ID NO: 164, or
a first polypeptide chain of SEQ ID NO: 291 and a second polypeptide chain of SEQ ID NO: 170, or
a first polypeptide chain of SEQ ID NO: 291 and a second polypeptide chain of SEQ ID NO: 172, or
a first polypeptide chain of SEQ ID NO: 291 and a second polypeptide chain of SEQ ID NO: 174, or
a first polypeptide chain of SEQ ID NO:166 and a second polypeptide chain of SEQ ID NO: 170, or
a first polypeptide chain of SEQ ID NO: 166 and a second polypeptide chain of SEQ ID NO: 172, or
a first polypeptide chain of SEQ ID NO:166 and a second polypeptide chain of SEQ ID NO: 174, or
a first polypeptide chain of SEQ ID NO: 291 and a second polypeptide chain of SEQ ID NO: 182, or
a first polypeptide chain of SEQ ID NO: 291 and a second polypeptide chain of SEQ ID NO: 185, or
a first polypeptide chain of SEQ ID NO: 175 and a second polypeptide chain of SEQ ID NO: 186, or
a first polypeptide chain of SEQ ID NO: 178 and a second polypeptide chain of SEQ ID NO: 186, or
a first polypeptide chain of SEQ ID NO: 180 and a second polypeptide chain of SEQ ID NO: 186;

in particular
a first polypeptide chain of SEQ ID NO: 100 and a second polypeptide chain of SEQ ID NO: 101, or
a first polypeptide chain of SEQ ID NO: 103 and a second polypeptide chain of SEQ ID NO: 102, or
a first polypeptide chain of SEQ ID NO: 105 and a second polypeptide chain of SEQ ID NO: 104, or
a first polypeptide chain of SEQ ID NO: 158 and a second polypeptide chain of SEQ ID NO: 300, or
a first polypeptide chain of SEQ ID NO: 167 and a second polypeptide chain of SEQ ID NO: 160, or
a first polypeptide chain of SEQ ID NO: 183 and a second polypeptide chain of SEQ ID NO: 176, or
a first polypeptide chain of SEQ ID NO: 193 and a second polypeptide chain of SEQ ID NO: 186, or
a first polypeptide chain of SEQ ID NO: 285 and a second polypeptide chain of SEQ ID NO: 284, or
a first polypeptide chain of SEQ ID NO: 291 and a second polypeptide chain of SEQ ID NO: 164, or
a first polypeptide chain of SEQ ID NO: 291 and a second polypeptide chain of SEQ ID NO: 284, or
a first polypeptide chain of SEQ ID NO: 295 and a second polypeptide chain of SEQ ID NO: 186, or
a first polypeptide chain of SEQ ID NO: 295 and a second polypeptide chain of SEQ ID NO: 296, or
a first polypeptide chain of SEQ ID NO: 299 and a second polypeptide chain of SEQ ID NO: 162, or
a first polypeptide chain of SEQ ID NO: 285 and a second polypeptide chain of SEQ ID NO: 300, or
a first polypeptide chain of SEQ ID NO: 303 and a second polypeptide chain of SEQ ID NO: 162, or
a first polypeptide chain of SEQ ID NO: 291 and a second polypeptide chain of SEQ ID NO: 300;
even more particularly
a first polypeptide chain of SEQ ID NO: 158 and a second polypeptide chain of SEQ ID NO: 300, or
a first polypeptide chain of SEQ ID NO: 291 and a second polypeptide chain of SEQ ID NO: 164.

Thus, in the most preferred embodiment, the antigen binding protein may comprise a first polypeptide chain of SEQ ID NO: 158 and a second polypeptide chain of SEQ ID NO: 300.

scTCR

In some embodiments, the first and the second polypeptide, and thus $V_A$ and $V_B$ are located on a single polypeptide chain. In such embodiments, the antigen binding protein of the invention can be described as a single chain TCR. However, depending on the FR sequences and constant domains comprised in the antigen binding protein, it may also be referred to as single chain antibody or single chain TCR-antibody molecule, as discussed above.

A scTCR can comprise a variable domain derived from a first TCR or at least comprising CDRs derived from a first TCR, a variable domain derived from a second TCR or at least comprising CDRs derived from a second TCR and a constant domain of the first or second TCR; in other words, the single chain TCR comprises a variable domain derived from one TCR (e.g. from an α- or γ-chain) and an entire chain (e.g. a β- or δ-chain) of another TCR, or vice versa. Furthermore, the scTCR can optionally comprise one or more linkers, preferably peptide linkers, which join the domains together. Also provided is such a scTCR of the invention, which is fused to a human cytokine, such as IL-2, IL-7 or IL-15.

In one embodiment, said single chain TCR is in one of the single chain formats selected from the group consisting of $V_A$-$L_t$-$V_B$, $V_B$-$L_t$-$V_A$, $V_A$-$C_\alpha$-$L_t$-$V_B$, $V_A$-$C_\beta$-$L_t$-$V_B$, $V_A$-$L_t$-$V_B$-$C_\beta$, $V_A$-$L_t$-$V_B$-$C_\alpha$, $V_A$-$C_\alpha$-$L_t$-$V_B$-$C_\beta$, $V_A$-$C_\beta$-$L_t$-$V_B$-$C_\alpha$, preferably $V_A$-$L_t$-$V_B$, $V_B$-$L_t$-$V_A$, wherein $V_A$ is a first variable domain as defined herein above and wherein $V_B$ is a second variable domain as defined herein above, Ca and Ca are TCR alpha and beta constant domains which are present or absent, respectively, and $L_t$ is a linker which is present or absent and as defined herein above in the section definitions.

In particular embodiments, the antigen binding protein of the invention is a scTCR comprising the amino acid sequence of any of SEQ ID NO: 79-87 or 89-92 or an amino acid sequence at least 85% identical to SEQ ID NO: 79-87 or 89-92, preferably the amino acid sequence of SEQ ID NO: 87.

scTCR-Fab

A single chain TCR may comprise a further variable domain, either C- or N-terminally linked, in particular $V_L$ and/or $V_H$ as described above.

In one embodiment, such a further variable domain may be linked via a linker $L_k$. In one preferred embodiment, the linker $L_k$ is a linker as defined herein above or a Hinge-$C_{H1}$ sequence of the amino acid sequence SEQ ID NO: 360.

In particular embodiments, the antigen binding protein of the invention is a scTCR-Fab comprising a first polypeptide chain comprising $V_A$, $V_B$ and of $V_L$ or $V_H$, preferably $V_H$, and a second polypeptide chain comprising the other of $V_L$ and $V_H$, preferably $V_L$. Preferably, the scTCR-Fab comprises a first polypeptide chain comprising or consisting of an amino acid sequence of any of SEQ ID NO: 94-98 or an amino acid sequence at least 85% identical to SEQ ID NO: 94-98, and a second polypeptide chain comprising or consisting of an amino acid sequence of any of SEQ ID NO: 93 or an amino acid sequence at least 85% identical to SEQ ID NO: 93.

Full-Length TCR

In another embodiment, the antigen binding protein of the invention comprises two polypeptide chains, wherein $V_A$ is comprised in a (full-length) TCR α- or γ-chain; and $V_B$ is comprised in a (full-length) TCR β- or δ-chain. In such embodiments, the antigen binding protein has preferably the structure of a conventional αβ TCR or γδ TCR as described above. In one embodiment, the TCR is an αβ TCR and comprises an α-chain constant domain (TRAC) sequence according to SEQ ID NO: 361 and a β-chain constant domain (TRBC1 or TRBC2) sequence according to SEQ ID NO: 362.

In one embodiment, the TCR constant domain sequences may be derived from any suitable species, such as any mammal, e.g., human, rat, monkey, rabbit, donkey, or mouse, preferably human. In some preferred embodiments, the TCR constant domain sequences may be slightly modified, for example, by the introduction of heterologous sequences, preferably mouse sequences, which may increase TCR expression and stability. Also, further stabilizing mutations as known from the state of the art (e.g. WO2018/104407, PCT/EP2018/069151, WO2011/044186. WO2014/018863) may be introduced, such as replacement of unfavorable amino acids in the variable regions and/or the introduction of a disulfide bridge between the TCR C domains and the removal of unpaired cysteine.

In particular, the TCR constant domain sequences may be modified by truncation or substitution to delete the native disulphide bond between Cys4 of exon 2 of TRAC and Cys2 of exon 2 of TRBC1 or TRBC2. The alpha and/or beta chain constant domain sequence(s) may also be modified by substitution of cysteine residues for Thr 48 of TRAC and Ser 57 of TRBC1 or TRBC2, the said cysteines forming a disulphide bond between the alpha and beta constant domains of the TCR. TRBC1 or TRBC2 may additionally include a cysteine to alanine mutation at position 75 of the constant domain and an asparagine to aspartic acid mutation at position 89 of the constant domain. The constant domain may additionally or alternatively contain further mutations, substitutions or deletions relative to the native TRAC and/or TRBC1/2 sequences. The term TRAC and TRBC1/2 encompasses natural polymorphic variants, for example N to K at position 4 of TRAC (Bragado et al Int Immunol. 1994 February; 6(2):223-30).

The invention also includes particles displaying antigen binding protein, in particular TCRs, and the inclusion of said particles within a library of particles. Such particles include but are not limited to phage, yeast, ribosomes, or mammalian cells. Method of producing such particles and libraries are known in the art (for example see WO2004/044004; WO01/48145, Chervin et al. (2008) J. Immuno. Methods 339.2:175-184).

Nucleic Acids, Vectors and Recombinant Host Cells

In a second aspect, the invention relates to an isolated nucleic acid comprising or consisting of a sequence encoding the antigen binding protein of the first aspect of the invention.

The term "nucleic acid" refers in the context of this invention to single or double-stranded oligo- or polymers of deoxyribonucleotide or ribonucleotide bases or both. Nucleotide monomers are composed of a nucleobase, a five-carbon sugar (such as but not limited to ribose or 2'-deoxyribose), and one to three phosphate groups. Typically, a nucleic acid is formed through phosphodiester bonds between the individual nucleotide monomers, In the context of the present invention, the term nucleic acid includes but is not limited to ribonucleic acid (RNA) and deoxyribonucleic acid (DNA) molecules but also includes synthetic forms of nucleic acids comprising other linkages (e.g., peptide nucleic acids as described in Nielsen et al. (Science 254:1497-1500, 1991). Typically, nucleic acids are single- or double-stranded molecules and are composed of naturally occurring nucleotides. The depiction of a single strand of a nucleic acid also defines (at least partially) the sequence of the complementary strand. The nucleic acid may be single or double stranded or may contain portions of both double and single stranded sequences. Exemplified, double-stranded nucleic acid molecules can have 3' or 5' overhangs and as such are not required or assumed to be completely double-stranded over their entire length. The term nucleic acid comprises chromosomes or chromosomal segments, vectors (e.g., expression vectors), expression cassettes, naked DNA or RNA polymer, primers, probes. cDNA, genomic DNA, recombinant DNA, cRNA, mRNA, tRNA, microRNA (miRNA) or small interfering RNA (siRNA). A nucleic acid can be, e.g., single-stranded, double-stranded, or triple-stranded and is not limited to any particular length. Unless otherwise indicated, a particular nucleic acid sequence comprises or encodes complementary sequences, in addition to any sequence explicitly indicated.

The nucleic acids may be present in whole cells, in a cell lysate, or may be nucleic acids in a partially purified or substantially pure form. A nucleic acid is "isolated" or "rendered substantially pure" when purified away from other cellular components or other contaminants, e.g., other cellular nucleic acids or proteins, by standard techniques.

Nucleic acid molecules of the disclosure can be obtained using standard molecular biology techniques, including but not limited to methods of amplification, and reverse transcription of RNA. Once DNA fragments encoding, for example, variable chains are obtained, these DNA fragments can be further manipulated by standard recombinant DNA techniques, for example to convert the variable region genes to full-length chain genes. In these manipulations, a variant-encoding DNA fragment is operatively linked to another DNA molecule, or to a fragment encoding another protein, such as a constant region or a flexible linker. The term "operatively linked", as used in this context, is intended to mean that the two DNA fragments are joined in a functional manner, for example, such that the amino acid sequences encoded by the two DNA fragments remain in-frame, or such that the protein is expressed under control of a desired promoter. The isolated DNA encoding the variable region, e.g. the variable alpha region and/or variable beta region, can be converted to a full-length chain gene by operatively linking the variable-encoding DNA to another DNA molecule encoding constant regions. The sequences of human constant region genes, e.g. for TCRs or antibodies, are known in the art and DNA fragments encompassing these regions can be obtained by standard PCR amplification.

Typically, said nucleic acid is a DNA or RNA molecule, which may be included in a suitable vector.

The first polypeptide and the second polypeptide described herein can be encoded on one nucleic acid molecule or two separate nucleic acid molecules.

Accordingly, also provided herein are expression vectors and host cells for producing the antigen binding proteins or functional fragments thereof described herein.

In a third aspect, the invention relates to a vector comprising the nucleic acid of the second aspect of the invention.

The terms "vector", "cloning vector" and "expression vector" refers to a vehicle by which a DNA or RNA sequence (e.g. a foreign gene) can be introduced into a host cell, so as to transform the host and promote expression (e.g. transcription and translation) of the introduced sequence.

Various expression vectors can be employed to express the polynucleotides encoding the antigen binding proteins or functional fragments thereof. Both viral-based and non-viral expression vectors can be used to produce the antigen binding proteins or functional fragments thereof described herein in a mammalian host cell. Non-viral vectors and systems include plasmids, plasmid, cosmic, episome, artificial chromosome, phage or a viral vector.

Such vectors may comprise regulatory elements, such as a promoter, enhancer, terminator and the like, to cause or direct expression of said polypeptide upon administration to a subject. Examples of promoters and enhancers used in the expression vector for animal cell include early promoter and enhancer of SV40 (Mizukami T. et al. 1987), LTR promoter and enhancer of Moloney mouse leukemia virus (Kuwana Y et al. 1987), promoter (Mason J O et al. 1985) and enhancer (Gillies S D et al. 1983) of antibody heavy chain and the like.

For example, non-viral vectors useful for expression of polynucleotides and polypeptides described herein in mammalian (e.g. human or non-human) cells include all suitable vectors known in the art for expressing proteins Other examples of plasmids and include replicating plasmids comprising an origin of replication, or integrative plasmids, such as for instance pUC, pcDNA, pBR, and the like.

The term "viral vector" refers to a nucleic acid vector construct that includes at least one element of viral origin and has the capacity to be packaged into a viral vector particle and encodes at least an exogenous nucleic acid. The vector and/or particle can be utilized for the purpose of transferring a nucleic acid of interest into cells either in vitro or in vivo. Numerous forms of viral vectors are known in the art. Useful viral vectors include vectors based on retroviruses, lentiviruses, adenoviruses, adeno-associated viruses, herpes viruses, vectors based on SV40, papilloma virus, Epstein Barr virus, vaccinia virus vectors, and Semliki Forest virus (SFV). Recombinant viruses may be produced by techniques known in the art, such as by transfecting packaging cells or by transient transfection with helper plasmids or viruses. Typical examples of virus packaging cells include PA317 cells, PsiCRIP cells, GPenv+ cells, 293 cells, etc. Detailed protocols for producing such replication-defective recombinant viruses may be found for instance in WO 95/14785, WO 96/22378, U.S. Pat. Nos. 5,882,877, 6,013,516, 4,861,719, 5,278,056 and WO 94/19478.

The nucleic acids encoding the first polypeptide and the second polypeptide described herein can be present in the same vector or separate vectors. The first polypeptide and the second polypeptide described herein can be present in the same vector or separate vectors.

In a fourth aspect, the invention relates to a host cell comprising the antigen binding protein of the first aspect, the nucleic acid of the second aspect or the vector of the third aspect of the invention. The host cell may have been transfected, infected or transformed with a nucleic acid and/or a vector according to the invention.

The term "transformation" means the introduction of a "foreign" (i.e. extrinsic) gene, DNA or RNA sequence to a host cell, so that the host cell will express the introduced gene or sequence to produce a desired substance, typically the antigen-binding protein or functional fragment thereof described herein. A host cell that receives and expresses introduced DNA or RNA has been "transformed".

The nucleic acids of the invention may be used to produce a recombinant antigen binding protein of the invention in a suitable expression system. The term "expression system" means a host cell and compatible vector under suitable conditions, e.g. for the expression of a protein coded for by foreign DNA carried by the vector and introduced to the host cell.

Common expression systems include E. coli host cells and plasmid vectors, insect host cells and Baculovirus vectors, and mammalian host cells and vectors. Other examples of host cells include, without limitation, prokaryotic cells (such as bacteria) and eukaryotic cells (such as yeast cells, mammalian cells, insect cells, plant cells, etc.). Specific examples include *E. coli, Kluyveromyces* or *Saccharomyces* yeasts, mammalian cell lines (e.g., Vero cells, CHO cells, 3T3 cells, COS cells, HEK cells, etc.) as well as primary or established mammalian cell cultures (e.g., produced from lymphoblasts, fibroblasts, embryonic cells, epithelial cells, nervous cells, adipocytes, etc.). Examples also include mouse SP2/0-Ag14 cell (ATCC CRL1581), mouse P3X63-Ag8.653 cell (ATCC CRL1580), CHO cell in which a dihydrofolate reductase gene is defective (Urlaub G et al; 1980), rat YB2/3HL.P2.G11.16Ag.20 cell (ATCC CRL1662), and the like. In some embodiments, the YB2/0 cell may be preferred, since ADCC activity of chimeric or humanized antibodies is enhanced when expressed in this cell.

According to the above, in one embodiment, the invention refers to a host cell comprising the antigen binding protein of the invention which is defined herein above, or the nucleic acid encoding the antigen binding protein of the invention, or the vector encoding the antigen binding protein of the invention, wherein said host cell preferably is a) a lymphocyte, such as a T lymphocyte or T lymphocyte progenitor cell, for example a CD4 or CD8 positive T cell or b) a cell for recombinant expression, such as a Chinese Hamster Ovary (CHO) cell.

In particular, for expression of some of the antigen binding proteins of the invention, in particular the antigen binding proteins comprising two polypeptides that are not linked, the expression vector may be either of a type in which a gene encoding an antibody heavy chain and a gene encoding an antibody light chain exists on separate vectors or of a type in which both genes exist on the same vector (tandem type). In respect of easiness of construction of antigen binding protein expression vector, easiness of introduction into animal cells, and balance between the expression levels of antibody H and L chains in animal cells, humanized antibody expression vector of the tandem type is preferred (Shitara K et at J Immunol Methods. 1994 Jan. 3; 167(1-2):271-8). Examples of tandem type humanized antibody expression vector include pKANTEX93 (WO 97/10354), pEE18 and the like.

In one embodiment, such recombinant host cells can be used for the production of at least one antigen binding protein of the invention.

Pharmaceutical Compositions

In a fifth aspect, the invention relates to a pharmaceutical composition comprising the antigen binding protein of the invention, the nucleic acids of the invention, the vector of the invention, or the host cell of the invention and a pharmaceutically acceptable carrier.

Antigen binding proteins of the present invention have been shown to be capable of effecting cytotoxicity against tumor cells. Thus, the antigen binding proteins of the present invention are useful for destroying tumor cells in a patient. An immune response in a patient can be induced by direct administration of the described antigen binding proteins to the patient, ideally in combination with an agent enhancing the immunogenicity (i.e. an adjuvant). The immune response originating from such a therapeutic vaccination can be expected to be highly specific against tumor cells because the peptide SLLQHLIGL (SEQ ID NO: 50) is not presented or over-presented on normal tissues in comparable copy numbers, preventing the risk of undesired autoimmune reactions against normal tissue cells in the patient.

The invention also relates to an antigen binding protein according to the invention, for use as a medicament. The invention also relates to a pharmaceutical composition of the invention for use as a medicament.

The terms "pharmaceutical composition" or "therapeutic composition" as used herein refer to a compound or composition capable of inducing a desired therapeutic effect when properly administered to a subject.

In some embodiments, the subject may also be referred to as patient.

Such therapeutic or pharmaceutical compositions may comprise a therapeutically effective amount of an antigen binding protein of the invention or an antigen binding protein further comprising a therapeutic agent, in admixture with a pharmaceutically or physiologically acceptable formulation agent selected for suitability with the mode of administration.

Antigen binding protein of the present invention will usually be supplied as part of a sterile, pharmaceutical composition which will normally include a pharmaceutically acceptable carrier and/or a pharmaceutically acceptable carrier diluent.

"Pharmaceutically" or "pharmaceutically acceptable" refers to molecular entities and compositions that do not produce an adverse, allergic or other untoward reaction when administered to a mammal, especially a human, as appropriate. A pharmaceutically acceptable carrier or excipient refers to a non-toxic solid, semi-solid or liquid filler, diluent, encapsulating material or formulation auxiliary of any type.

A "pharmaceutically-acceptable carrier or excipient" may also be referred to as pharmaceutically acceptable diluent"or pharmaceutically acceptable vehicles" and may include solvents, bulking agents, stabilizing agents, dispersion media, coatings, antibacterial and antifungal agents, isotonic and absorption delaying agents, and the like which are physiologically compatible. Accordingly, in one embodiment the carrier is an aqueous carrier.

In another aspect, the aqueous carrier is capable of imparting improved properties when combined with an antigen binding protein described herein, for example, improved solubility, efficacy, and/or improved immunotherapy.

The form of the pharmaceutical compositions, the route of administration, the dosage and the regimen naturally depend upon the condition to be treated, the severity of the illness, the age, weight, and gender of the patient, etc. This pharmaceutical composition may be in any suitable form, (depending upon the desired method of administering it to a patient). It may be provided in unit dosage form, will generally be provided in a sealed container and may be provided as part of a kit. Such a kit would normally (although not necessarily) include instructions for use. It may include a plurality of said unit dosage forms.

Empirical considerations, such as the biological half-life, generally will contribute to the determination of the dosage. Frequency of administration may be determined and adjusted over the course of therapy and is based on reducing the number of cancer cells, maintaining the reduction of cancer cells, reducing the proliferation of cancer cells, or killing the cancer cells. Alternatively, sustained continuous release formulations of the antigen binding protein may be appropriate. Various formulations and devices for achieving sustained release are known in the art.

In one embodiment, dosages for the antigen binding proteins may be determined empirically in individuals who have been given one or more administration(s). Individuals are given incremental dosages of the antigen binding protein. To assess efficacy of the antigen binding protein, a marker of the cancer cell state can be followed. These include direct measurements of cancer cell proliferation and cell death by FACS, other imaging techniques; an improvement in health as assessed by such measurements, or an increase in quality of life as measured by accepted tests or prolongation of survival. It will be apparent to one of skill in the art that the dosage will vary depending on the individual, the stage of the disease, and the past and concurrent treatments being used.

In particular, the pharmaceutical compositions contain vehicles, which are pharmaceutically acceptable for a formulation capable of being injected. These may be in particular isotonic, sterile, saline solutions (monosodium or disodium phosphate, sodium, potassium, calcium or magnesium chloride and the like or mixtures of such salts), or dry, especially freeze-dried compositions which upon addition, depending on the case, of sterilized water or physiological saline, permit the constitution of injectable solutions.

The doses used for the administration can be adapted as a function of various parameters, and in particular as a function of the mode of administration used, of the relevant pathology, or alternatively of the desired duration of treatment.

To prepare pharmaceutical compositions, an effective amount of the antigen binding protein of the invention may be dissolved or dispersed in a pharmaceutically acceptable carrier or aqueous medium.

The pharmaceutical forms suitable for injectable use include sterile aqueous solutions or dispersions; formulations including sesame oil, peanut oil or aqueous propylene glycol; and sterile powders for the extemporaneous preparation of sterile injectable solutions or dispersions. In all cases, the form must be sterile and must be fluid to the extent that easy syringability exists. It must be stable under the conditions of manufacture and storage and must be preserved against the contaminating action of microorganisms, such as bacteria and fungi.

Solutions of the active compounds as free base or pharmacologically acceptable salts can be prepared in water suitably mixed with a surfactant, such as hydroxypropylcellulose. Dispersions can also be prepared in glycerol, liquid polyethylene glycols, and mixtures thereof and in oils. Under ordinary conditions of storage and use, these preparations contain a preservative to prevent the growth of microorganisms.

An antigen-binding protein of the invention can be formulated into a composition in a neutral or salt form. Pharmaceutically acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, glycine, histidine, procaine and the like.

Sterile injectable solutions are prepared by incorporating the active compounds in the required amount in the appropriate solvent with various of the other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof.

The preparation of more, or highly concentrated solutions for direct injection is also contemplated, where the use of DMSO as solvent is envisioned to result in extremely rapid penetration, delivering high concentrations of the active agents to a small tumor area.

Upon formulation, solutions will be administered in a manner compatible with the dosage formulation and in such amount as is therapeutically effective. The formulations are easily administered in a variety of dosage forms, such as the type of injectable solutions described above, but drug release capsules and the like can also be employed.

Methods of Producing Antigen Binding Proteins

In a sixth aspect, the invention relates to a method of producing the antigen binding protein of the first aspect of the invention, comprising
    (a) providing a host cell,
    (b) providing a genetic construct comprising a coding sequence encoding the antigen binding protein,
    (c) introducing said genetic construct into said host cell, and
    (d) expressing said genetic construct by said host cell, and optionally
    (e) selecting the cells which express and/or secrete said antigen binding protein.

In one embodiment, the method further comprises the isolation and purification of the antigen binding protein from the host cell and, optionally, reconstitution of the antigen binding protein in a T cell. The skilled person is entirely capable of selecting suitable host cells for expressing an antigen binding protein.

An antigen binding protein of the invention may be produced by any technique known in the art, such as, without limitation, any chemical, biological, genetic or enzymatic technique, either alone or in combination.

Antigen binding proteins of the invention are suitably separated from the culture medium by antibody purification procedures such as, for example, protein A-sepharose, hydroxylapatite chromatography, gel electrophoresis, dialysis, or affinity chromatography.

In one embodiment, recovering the expressed antigen binding proteins or polypeptides herein refers to performing a protein A chromatography, a Kappa select chromatography, and/or a size exclusion chromatography, preferably a protein A chromatography and/or a size exclusion chromatography, more preferably a protein A chromatography and a size exclusion chromatography.

Knowing the amino acid sequence of the desired sequence, one skilled in the art can produce the antigen binding proteins of the present invention, by standard techniques for production of polypeptides. For instance, they can be synthesized using well-known solid phase method, in particular using a commercially available peptide synthesis apparatus (such as that made by Applied Biosystems, Foster City, California) and following the manufacturer's instructions. Alternatively, antibodies, and antigen binding proteins of the invention can be produced by recombinant DNA and gene transfection techniques well known in the art (see Morrison S L. et al. (1984) and patent documents U.S. Pat. Nos. 5,202,238 and 5,204,244). For example, fragments can be obtained as DNA expression products after incorporation of DNA sequences encoding the desired (poly)peptide into expression vectors and introduction of such vectors into suitable eukaryotic or prokaryotic hosts that will express the desired polypeptide, from which they can be later isolated using well-known techniques.

In one example, i.e. In case of TCER®, DNA-sequences coding for various combinations of VH and VL and variable alpha (Valpha) and variable beta (Vbeta), as well as coding for linkers may be obtained by, for instance, gene synthesis. Resulting DNA-sequences may be cloned in frame into expression vectors coding for hinge region, $CH_2$ and $CH_3$ domain derived from, for example, human IgG4 [Accession #: K01316] and IgG1 [Accession #: P01857], respectively and may be further engineered. Engineering may be performed to incorporate knob-into-hole mutations into $CH_3$-domains with and without additional interchain disulfide bond stabilization; to remove an N-glycosylation site in $CH_2$ (e.g. N2970 mutation); to introduce $F_c$-silencing mutations or to introduce additional disulfide bond stabilization into $V_L$ and $V_H$, respectively, according to the methods described by Reiter et al. (Stabilization of the Fv Fragments in Recombinant Immunotoxins by Disulfide Bonds Engineered into Conserved Framework Regions. Biochemistry, 1994, 33, 5451-5459).

Methods for producing humanized antibodies based on conventional recombinant DNA and gene transfection techniques are well known in the art (See, e.g., Riechmann L. et al. 1988; Neuberger M S. et al. 1985) and can be easily applied to the production of antigen binding proteins.

In one example, vectors for the expression of the recombinant antigen binding proteins of the invention were designed as monocistronic, for instance, controlled by HCMV-derived promoter elements, pUC19-derivatives. Plasmid DNA was amplified, for example, in *E. coli* according to standard culture methods and subsequently purified using commercial-available kits (Macherey & Nagel). Purified plasmid DNA was used for transient transfection of, for example, CHO-S cells according to instructions of the manufacturer (ExpiCHO™ system; Thermo Fisher Scientific). Transfected CHO-cells were cultured, for instance, for 6-14 days at, for example, 32° C. to 37° C., and received one to two feeds of ExpiCHO™ Feed solution.

Conditioned cell supernatant was cleared by, for example, filtration (0.22 μm) utilizing, for instance, Sartoclear Dynamics® Lab Fitter Aid (Sartorius). Bispecific antigen binding proteins were purified using, for example, an Äkta Pure 25 L FPLC system (GE Lifesciences) equipped to perform affinity and size-exclusion chromatography in line. Affinity chromatography was performed on, for example, protein A or L columns (GE Lifesciences) following standard affinity chromatographic protocols. For instance, size exclusion chromatography was performed directly after elution (pH 2.8) from the affinity column to obtain highly pure monomeric protein using, for example, Superdex 200 pg 16/600 columns (GE Lifesciences) following standard protocols. Protein concentrations were determined on, for example, a NanoDrop system (Thermo Scientific) using calculated extinction coefficients according to predicted protein sequences. Concentration was adjusted, if needed, by using Vivaspin devices (Sartorius). Finally, purified molecules were stored in, for example, phosphate-buffered saline at concentrations of about 1 mg/mL at temperatures of 2-8° C.

Quality of purified bispecific antigen binding proteins was determined by, for example, HPLC-SEC on MabPac SEC-1 columns (5 μm, 7.8×300 mm) running in, for example, 50 mM sodium-phosphate pH 6.8 containing 300 mM NaCl within a Vanquish UHPLC-System.

Therapeutic Methods and Uses

In a seventh aspect, the invention provides the antigen binding protein of the first aspect, the nucleic acid of the second aspect, the vector of the third aspect, the host cell of the fourth aspect, or the pharmaceutical composition of the fifth aspect for use in medicine, in particular for use in the diagnosis, prevention, and/or treatment of a proliferative disease. It is preferred that for a therapeutic use (i.e. prevention, and/or treatment), the antigen binding protein comprises a first antigen binding site binding to the PRAME antigenic peptide in a complex with MHC (i.e. the antigen binding site formed by $V_A$ and $V_B$) and a second antigen binding site binding to an antigen of an effector cell (i.e. the antigen binding site formed by $V_L$ and $V_H$). The inventors have shown in the experimental section in vitro for several bi-specific compounds of the invention, the cytotoxic activity of those constructs for PRAME positive cancer cell lines such as Hs695T and U2OS. The inventors have furthermore demonstrated that said cytotoxic activity is highly specific and limited to PRAME-positive cells since only marginal lysis was induced by the bispecific antigen binding proteins in cell lines not presenting the peptide PRAME-004.

Accordingly, the antigen binding proteins of the present invention, in particular bispecific antigen binding proteins, such as a TCER®, may be used to treat cancer. The antigen binding proteins of the present invention may be used for therapeutic purposes in humans and/or non human mammalian animals. In one embodiment, the antigen binding proteins of the present invention can bind to tumor cells and reduce the growth of and/or kill the tumor cells presenting the peptide SLLQHLIGL (SEQ ID NO: 50):MHC complex on their cell surface. It is understood that the antigen binding protein is administered at a concentration that promotes binding at physiological (e.g., in vivo) conditions. In another embodiment, the antigen binding proteins can be used for immunotherapy directed at tumor cells of different tissues such as lung, breast, ovary or kidney. In another embodiment, the antigen binding proteins alone can bind to and reduce the growth of and/or kill tumor cells.

Therefore, the invention relates to a method of treating or preventing a proliferative disease or disorder comprising administering to a subject in need thereof a therapeutically effective amount of the antigen binding protein, the nucleic acid or vector, the host cell or the pharmaceutical composition according to the invention as defined herein above in the section "Antigen binding protein" "Nucleic acids" or "Pharmaceutical compositions".

In a particular embodiment, the invention relates to a method of treating a subject who has a proliferative disease comprising administering to said subject T cells expressing the antigen binding protein of the invention on the cell surface.

In a further embodiment, the invention refers to a method of eliciting an immune response in a subject, who has a proliferative disease, comprising administering to said subject a composition comprising T cells expressing the antigen recognizing construct of the invention on the cell surface.

In one embodiment, the immune response referred to in said method is a cytotoxic T cell response.

In one embodiment, the antigen binding protein of the invention, the nucleic acid of the invention or the vector of the invention, the host cell of the invention or the pharmaceutical composition of the invention are for use in the diagnosis, prevention, and/or treatment of a proliferative disease.

The invention further refers to the use of an antigen binding protein, the nucleic acid or vector, the host cell or the pharmaceutical composition according to the invention for the preparation of a medicament for treating or preventing a proliferative disease or disorder in a subject.

In one embodiment, the invention refers to methods of eliciting an immune response in a patient who has cancer that presents a peptide comprising or consisting of the amino acid sequence of SLLQHLIGL (SEQ ID NO: 50) in a complex with an MHC protein, comprising administering to the patient an antigen binding protein of the present disclosure, wherein said cancer is selected from the group of cancers consisting of acute myeloid leukemia, breast cancer, cholangiocellular carcinoma, gallbladder cancer, glioblastoma, hepatocellular carcinoma, head and neck squamous cell carcinoma, melanoma, amelanotic melanoma, non-Hodgkin lymphoma, non-small cell lung cancer adenocarcinoma, non-small cell lung cancer, squamous cell non-small cell lung cancer, ovarian cancer, esophageal cancer, renal cell carcinoma, small cell lung cancer, urinary bladder carcinoma, uterine and endometrial cancer, osteosarcoma, chronic lymphocytic leukemia, colorectal carcinoma, and synovial sarcoma.

In one embodiment, the invention refers to the use of the antigen binding protein, the nucleic acid or vector, the host cell or the pharmaceutical composition according to the invention for treating or preventing a disease or disorder in a subject.

The terms "subject" or "individual" are used interchangeably and may be, for example, a human or a non-human mammal, preferably, a human.

In the context of the invention, the terms "treating" or "treatment", refer to a therapeutic use (i.e. on a subject having a given disease) and means reversing, alleviating, inhibiting the progress of one or more symptoms of such disorder or condition. Therefore, treatment does not only refer to a treatment that leads to a complete cure of the disease, but also to treatments that slow down the progression of the disease and/or prolong the survival of the subject.

By "preventing" is meant a prophylactic use (i.e. on a subject susceptible of developing a given disease).

In one embodiment, a "disease" or "disorder" is any condition that would benefit from treatment with the antigen binding protein of the invention. In one embodiment, this includes chronic and acute disorders or diseases including those pathological conditions which predisposes the subject to the disorder in question. The term "in need of treatment" refers to a subject having already the disorder as well as those in which the disorder is to be prevented.

In a particular embodiment, the antigen binding proteins of the present invention are bispecific, more particularly TCER®, as herein described.

"Proliferative diseases", such as cancer, involve the unregulated and/or inappropriate proliferation of cells.

Accordingly, in one embodiment, the proliferative disorder is cancer.

In a further embodiment, the cancer is a cancer where a PRAME-antigen is overexpressed, mutated, and/or a PRAME-derived tumor-associated antigen associated with MHC is presented.

Accordingly, a particularly preferred cancer is a PRAME positive cancer.

In the context of the present invention, a cancer is considered to be "PRAME "positive"", if the related peptide, such as, for example the PRAME-004 peptide, is presented in >98% of all cancers according to the guidelines by the NCI. In all other indications named here a biopsy can be performed as it is standard in the treatment of these cancers and the peptide can be identified according to the XPresident® and related methods (according to WO 03/100432; WO 2005/076009; WO 2011/128448; WO 2016/107740, U.S. Pat. Nos. 7,811,828, 9,791,444, and US 2016/0187351, the contents of each are hereby incorporated by reference in their entirety). In one embodiment, the cancer is readily assayed (i.e. diagnosed) for instance by using an antigen binding protein of the invention. Methods to identify an antigen expressing cancer using an antigen binding protein are known to the skilled in the art. It is to be understood that the terms "cancer" and "carcinoma" are not used interchangeably herein since a carcinoma is a specific type of cancer emerging in the skin or in tissues that line or cover body organs.

In one embodiment, the cancer that is PRAME "positive", i.e. that presents the target peptide, is selected from the group consisting of acute myeloid leukemia, breast cancer, cholangiocellular carcinoma, gallbladder cancer, glioblastoma, hepatocellular carcinoma, head and neck squamous cell carcinoma, melanoma, amelanotic melanoma, non-Hodgkin lymphoma, non-small cell lung cancer adenocarcinoma, non-small cell lung cancer, squamous cell non-small cell lung cancer, ovarian cancer, esophageal cancer, renal cell carcinoma, small cell lung cancer, urinary bladder carcinoma, uterine and endometrial cancer, osteosarcoma, chronic lymphocytic leukemia, colorectal carcinoma, and synovial sarcoma, preferably breast cancer, cholangiocellular carcinoma, hepatocellular carcinoma, head and neck squamous cell carcinoma, squamous cell non-small cell lung cancer, ovarian cancer, esophageal cancer, renal cell carcinoma, small cell lung cancer, urinary bladder carcinoma, uterine and endometrial cancer, and synovial sarcoma.

In one embodiment, wherein the cancer is a cancer where a PRAME-antigen is overexpressed, mutated, and/or a PRAME-derived tumor-associated antigen associated with MHC is presented, is readily assayed for instance by using an antigen binding protein of the invention. Methods to identify an antigen expressing cancer using an antigen-binding protein are known to the skilled in the art.

Among the texts providing guidance for cancer therapy is Cancer, Principles and Practice of Oncology, 4th Edition, DeVita et al, Eds. J. B. Lippincott Co., Philadelphia, Pa. (1993). An appropriate therapeutic approach is chosen according to the particular type of cancer, and other factors such as the general condition of the patient, as is recognized in the pertinent field. An antigen binding protein of the present invention can be used by itself or can be added to a therapy regimen using other anti-neoplastic agents in treating a cancer patient.

Accordingly, in some embodiments, the antigen binding protein can be administered concurrently with, before, or after a variety of drugs and treatments widely employed in cancer treatment such as, for example, chemotherapeutic agents, non-chemotherapeutic, anti-neoplastic agents, and/or radiation.

In one embodiment, the invention refers to methods of treating a patient who has cancer that presents a peptide comprising or consisting of the amino acid sequence of SLLQHLIGL (SEQ ID NO: 50) in a complex with an MHC protein, comprising administering to the patient the antigen binding protein of the present disclosure, wherein said cancer is selected from the group of cancers consisting of acute myeloid leukemia, breast cancer, cholangiocellular carcinoma, gallbladder cancer, glioblastoma, hepatocellular carcinoma, head and neck squamous cell carcinoma, melanoma, amelanotic melanoma, non-Hodgkin lymphoma, non-small cell lung cancer adenocarcinoma, non-small cell lung cancer, squamous cell non-small cell lung cancer, ovarian cancer, esophageal cancer, renal cell carcinoma, small cell lung cancer, urinary bladder carcinoma, uterine and endometrial cancer, osteosarcoma, chronic lymphocytic leukemia, colorectal carcinoma, and synovial sarcoma.

"Diagnosis" herein refers to a Medical diagnosis and refers to determining which disease or condition explains a person's symptoms and signs.

By a "therapeutically effective amount;" of the antigen binding protein or pharmaceutical composition thereof is meant a sufficient amount of the antigen binding protein to treat said proliferative disease, at a reasonable benefit/risk ratio applicable to any medical treatment. It will be understood, however, that the total daily usage of the antigen binding proteins, the nucleic acid or vector, the host cell or the pharmaceutical composition of the present invention will be decided by the attending physician within the scope of sound medical judgment. The specific therapeutically effective dose level for any particular patient will depend upon a variety of factors including the disorder being treated and the severity of the disorder; activity of the specific antigen binding protein employed; the specific composition employed, the age, body weight, general health, sex and diet of the patient; the time of administration, route of administration, and rate of excretion of the specific polypeptide employed; the duration of the treatment; drugs used in combination or coincidental with the specific polypeptide employed; and like factors well known in the medical arts. For example, it is well known within the skill of the art to start doses of the compound at levels lower than those required to achieve the desired therapeutic effect and to gradually increase the dosage until the desired effect is achieved.

In one embodiment, efficacy of the treatment with an antigen binding protein of the invention is assayed in vivo, for instance in a mouse model of cancer and by measuring, for example, changes in tumor volume between treated and control groups.

Pharmaceutical compositions, vectors, nucleic acids and cells of the invention may be provided in substantially pure form, for example at least 80%, at least 85%, at least 90%, at least 91%, at least 92%, at least 93%, at least 94%, at least 95%, at least 96%, at least 97%, at least 98%, at least 99% or 100% pure.

The antigen binding protein of the invention, the nucleic acid of the invention or the vector of the invention, the host cell of the invention or the pharmaceutical composition of the invention can be administered by any feasible method.

As herein disclosed, in some embodiments host cells as defined herein above are used in the herein described medical uses or treatment methods. In the same embodiment, the host cell is preferably a a) lymphocyte, such as a T lymphocyte or T lymphocyte progenitor cell, for example a CD4 or CD8 positive T cell, most preferably a T cell.

Accordingly, the host cell of the present invention, preferably the T cells, may be used as active ingredients of a therapeutic composition. Thus, the invention also provides a method of killing target cells in a patient whose target cells aberrantly express a polypeptide comprising the peptide SLLQHLIGL (SEQ ID NO: 50), the method comprising administering to the patient an effective number of host cells, preferably T cells. In the context of this method the host cells, once administered to the subject, preferably elicit an immune response.

In an aspect, the TCR-elicited immune response or T cell response may refer to the proliferation and activation of effector functions induced by a peptide, such as SLLQH-LIGL (SEQ ID NO: 50), in vitro or in vivo. For MHC class I restricted cytotoxic T cells, for example, effector functions may be lysis of peptide-pulsed, peptide-precursor pulsed or naturally peptide-presenting target cells, secretion of cytokines, preferably Interferon-gamma, TNF-alpha, or IL-2 induced by peptide, secretion of effector molecules, for example, granzymes or perforins induced by peptide, or degranulation.

Accordingly, the host cell as defined herein above may be from the subject (autologous) or from another individual: preferably, said other individual is healthy.

By "healthy" it is meant that the subject is generally in good health, preferably has a competent immune system and, more preferably, is not suffering from any disease that can be readily tested for and detected.

In specific example the host cell is a T cell. Accordingly, in the context of the present invention, when a T cell as defined herein above is used as a medicament, usually, T cells are collected from a subject by apheresis. Then the T cells are genetically engineered to express the antigen binding protein of the present invention on their cell surface, the genetically engineered T cells are then expanded and then re-infused into the subject. In this example, the antigen binding protein is preferably a TCR.

In another approach, the host cell may be a stem cell, such as a mesenchymal stem cell and is engineered to express the antigen binding protein of the invention. In this example, the antigen binding protein is a soluble protein such as an antibody, a scTCR or a diabody as defined herein above.

Accordingly, the host cell has been transfected, infected or transformed with a nucleic acid and/or a vector according to the invention, as described herein above in the section 'nucleic acids, vectors and recombinant host cells'.

When the host cell is transfected to express the antigen binding protein of the invention, preferably the cell comprises an expression vector capable of expressing the antigen binding protein. The host cell may then be referred to as activated host cell.

Protocols for this so-called adoptive transfer of T cells are well known in the art. Reviews can be found in: Gattioni et al, and Morgan et al. (Gattinoni, L. et al, Nat.Rev.Immunol. 6 (2006): 383-393; Morgan, R. A. et at, Science 314 (2006): 126-129).

A number of other methods may be used for generating T cells in vitro. For example, autologous tumor-infiltrating lymphocytes can be used in the generation of CTL. Plebanski et al. (Plebanski, M. et at, Eur.J Immunol 25 (1995): 1783-1787) made use of autologous peripheral blood lymphocytes (PCBs) in the preparation of T cells. Also, B cells can be used in the production of autologous T cells.

Allogeneic cells may also be used in the preparation of T cells and a method is described in detail in U.S. Pat. No. 6,805,861, incorporated herein by reference Host cells expressing the antigen binding protein of the invention directed against the peptides SLLQHLIGL (SEQ ID NO: 50) are useful in therapy. Thus, a further aspect of the invention provides activated host cells obtainable by the foregoing methods of the invention.

Activated host cells, which are produced by the above method, may specifically recognize a cell that aberrantly expresses a polypeptide that comprises the peptide SLLQH-LIGL (SEQ ID NO: 50).

By "aberrantly expressed" the inventors also mean that the polypeptide is overexpressed compared to levels of expression in normal (healthy) tissues or that the gene is silent in the tissue from which the tumor is derived but, in the tumor, it is expressed. By "overexpressed" the inventors mean that the polypeptide is present at a level at least 1.2-fold of that present in normal tissue; preferably at least 2-fold, and more preferably at least 5-fold or 10-fold the level present in normal tissue.

In an aspect, the host cell, in particular the T cell, recognizes the cell by interacting through its antigen binding protein, in particular its TCR, with the PRAME-004-complex (for example, binding). The host cells are useful in a method of killing target cells in a patient whose target cells aberrantly express a polypeptide comprising the peptide SLLQHLIGL (SEQ ID NO: 50) wherein the patient is administered an effective number of the activated host cells. The T cells that are administered to the patient may be derived from the patient and activated as described above (i.e. they are autologous T cells). Alternatively, the T cells are not from the patient but are from another individual. Of course, it is preferred if the individual is a healthy individual. By "healthy individual" the inventors mean that the individual is generally in good health, preferably has a competent immune system and, more preferably, is not suffering from any disease that can be readily tested for and detected.

In vivo, the target cells for the CD8-positive T cells according to the present invention can be cells of the tumor (which sometimes express MHC class II) and/or stromal cells surrounding the tumor (tumor cells) (which sometimes also express MHC class II; (Dengjel, J. et al., Clin Cancer Res 12 (2006): 4163-4170).

Diagnostic Use

PRAME is expressed on the surface of PRAME expressing cancers defined herein above. The antigen PRAME constitutes a cancer marker and, therefore, has the potential to be used to indicate the effectiveness of an anti-cancer therapy or detecting recurrence of the disease.

Thus, in another aspect, the invention provides the antigen binding protein of the first aspect, the nucleic acid of the second aspect, the vector of the third aspect, the host cell of the fourth aspect, or the pharmaceutical composition of the fifth aspect for use as a diagnostic agent, in particular for use as an in vivo diagnostic agent. In preferred embodiments, the diagnostic agent is for the diagnosis of a proliferative disease. In more preferred embodiments, the diagnostic agent is for the diagnosis of a cancer that presents a peptide comprising or consisting of the amino acid sequence of SLLQHLIGL (SEQ ID NO: 50) in a complex with an MHC protein, preferably wherein said cancer is selected from the group of cancers consisting of acute myeloid leukemia, breast cancer, cholangiocellular carcinoma, gallbladder cancer, glioblastoma, hepatocellular carcinoma, head and neck squamous cell carcinoma, melanoma, amelanotic melanoma, non-Hodgkin lymphoma, non-small cell lung cancer adenocarcinoma, non-small cell lung cancer, squamous cell non-small cell lung cancer, ovarian cancer, esophageal cancer, renal cell carcinoma, small cell lung cancer, urinary bladder carcinoma, uterine and endometrial cancer, osteosarcoma, chronic lymphocytic leukemia, colorectal carcinoma, and synovial sarcoma.

The skilled person is aware that for diagnostic purposes, the antigen binding protein comprises $V_A$ and $V_B$, but preferably not $V_L$ and $V_H$.

In an embodiment, the antigen binding protein of the invention is used as component of an assay in the context of a therapy targeting PRAME expressing tumours, in order to determine susceptibility of the patient to the therapeutic agent, monitor the effectiveness of the anti-cancer therapy or detect recurrence of the disease after treatment. In particular, an antigen binding protein comprising the $V_A$ and $V_B$ domains as herein defined is used as component of the diagnostic assay wherein a bispecific antigen binding protein is used as component of the therapeutic agent.

Thus, a further object of the invention relates to an antigen binding protein according to the invention for use for in vivo detecting PRAME expression in a subject, or for use for ex vivo or in vitro detecting PRAME expression in biological sample of a subject. Said detection may be intended in particular for
a) diagnosing the presence of a cancer in a subject, or
b) determining susceptibility of a patient having cancer to a therapeutic agent targeting PRAME, or
c) monitoring effectiveness of anti-PRAME cancer therapy or detecting cancer relapse after anti-PRAME cancer therapy, in particular for therapy with a bispecific according to the invention; by detecting expression of the surface protein PRAME on tumor cells.

In an embodiment, the antigen binding protein is intended for an in vitro or ex vivo use.

Kits

Finally, the invention also provides kits comprising at least one antigen binding protein of the invention.

In one embodiment, the kit comprises
a) at least one antigen binding protein of the invention as defined herein above in the section "antigen binding proteins",
b) optionally packaging material, and
c) optionally a label or packaging insert contained within said packaging material indicting that said antigen binding protein is effective for treating cancer or for use for the treatment of cancer.

In a related embodiment, the at least one antigen binding proteins of the invention is contained in a single and/or multi-chambered pre-filled syringes (e.g., liquid syringes and lyosyringes).

In one embodiment, the invention encompasses kits for producing a single-dose administration unit.

Accordingly, in one embodiment, the at least one antigen binding proteins of the invention as mentioned in a) of the kit of the invention is a dried antigen binding protein of the invention contained in a first container. The kit then further contains a second container having an aqueous formulation.

Accordingly, in one embodiment, the kit comprises
a) a first container comprising at least one dried antigen binding protein of the invention as defined herein above in the section "Antigen binding proteins",
b) a second container comprising an aqueous formulation;
c) optionally packaging material, and
d) optionally a label or packaging insert contained within said packaging material indicting that said antigen binding protein is for effective for treating cancer or for use for the treatment of cancer.

The aqueous formulation is typically an aqueous solution comprising pharmaceutically-acceptable carriers as defined herein above in the section "pharmaceutical compositions".

In a related embodiment, the "first container" and the "second" container refer to the chambers of a multi-chambered pre-filled syringes (e.g., lyosyringes).

Throughout the instant application, the term "and/or" is a grammatical conjunction that is to be interpreted as encompassing that one or more of the cases it connects may occur. For example, the wording "such native sequence proteins can be prepared using standard recombinant and/or synthetic methods" indicates that native sequence proteins can be prepared using standard recombinant and synthetic methods or native sequence proteins can be prepared using standard recombinant methods or native sequence proteins can be prepared using synthetic methods.

Furthermore, throughout the instant application, the term "comprising" is to be interpreted as encompassing all specifically mentioned features as well optional, additional, unspecified ones. As used herein, the use of the term "comprising" also discloses the embodiment wherein no features other than the specifically mentioned features are present (i.e. "consisting of").

Furthermore, the indefinite article "a" or "an" does not exclude a plurality. The mere fact that certain measures are recited in mutually different dependent claims does not indicate that a combination of these measures cannot be used to advantage.

The invention will now be described in more details with reference to the following figures and examples. All literature and patent documents cited herein are hereby incorporated by reference. While the invention has been illustrated and described in detail in the foregoing description, the examples are to be considered illustrative or exemplary and not restrictive.

BRIEF DESCRIPTION OF THE FIGURES

FIG. 1: Conversion of a TCR into stabilized scTCR via yeast surface display. ScTCR molecules displayed on the surface of transformed Saccharomyces cerevisiae EBY100 were stained with anti Myc-FITC antibody to determine expression level and PE-labeled HLA-A*02/PRAME-004 tetramer to investigate functional binding. The non-modified scTCR R11P3D3 (left panel, SEQ ID NO: 5) is compared to R11P1 D3_stabilised scTCR variant bearing nine stabilizing framework mutations and three single-point mutations in the CDRs (right panel, SEQ ID NO: 6), which was derived from the selection of the scTCR library.

FIG. 3: Binding of high affinity scTCR yeast clones to similar peptides. Yeast clones bearing stabilized scTCRs with maturated CDRs (SEQ ID NOs: 79 to 87 and 89 to 92) were stained with 100 nM HLA-A*02 monomers containing the PRAME-004 target peptide or one out of 7 similar peptides (SEQ ID NOs: 52 to 56 and 58 to 59).

PBMCs from a healthy HLA-A*02+ donor were co-cultured at a ratio 10:1 with the normal tissue cells or Hs695T tumor cells (in triplicates) in a 1:1 mixture of the respective normal tissue cell medium (3, 4, 8a, 10a, 13a or 16a) and T cell medium (LDH-AM) or in T cell medium alone. After 48 hours, lysis of normal tissue cells and Hs695T cells was assessed by measuring LDH release (LDH-Glo™ Kit, Promega).

Figure 13:
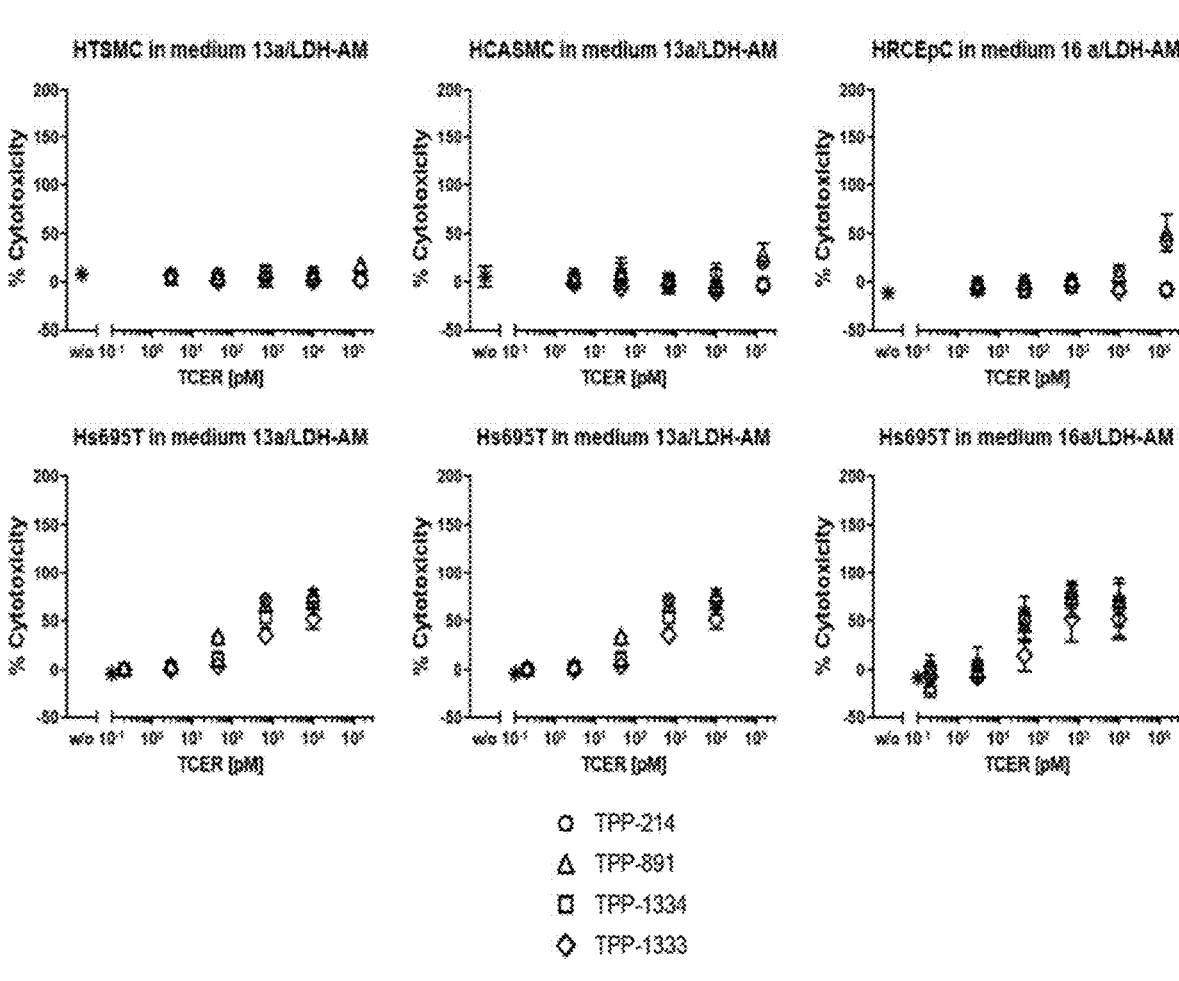

FIG. 13: Normal tissue cell safety analysis for selected TCER® Slot IV variants. TCER®-mediated cytotoxicity against 6 different normal tissue cell types expressing HLA-A*02 was assessed in comparison to cytotoxicity directed against PRAME-004-positive Hs695T tumor cells. PBMCs from a healthy HLA-A*02+ donor were co-cultured at a ratio 10:1 with the normal tissue cells or Hs695T tumor cells (in triplicates) in a 1:1 mixture of the respective normal tissue cell medium (10a, 13a or 16a) and T cell medium (LDH-AM). After 48 hours, lysis of normal tissue cells and Hs695T cells was assessed by measuring LDH release (LDH-Glo™, Kit, Promega).

EXAMPLES

Example 1: Single Chain TCR (scTCR Format)

Example 1.1: Generation of Stable scTCR

For the present invention, the TCR R11P3D3 (SEQ ID NOs: 1 and 2, full length) was converted into a single chain TCR construct (scTCR R11P3D3, SEQ ID NO: 5) using the variable alpha (SEQ ID NO: 3) and beta (SEQ ID NO: 4) domains and an appropriate glycine-serine linker sequence (SEQ ID NO: 61). For TCR maturation via yeast surface display, the DNA of the corresponding sequence was synthesized and transformed into *Saccharomyces cerevisiae* EBY100 (MATa AGA1::GAL1¬AGA1::URA3 ura3¬52 trp1 leu2¬detta200 his3¬delta200 pep4::HIS3 prbd1.6R can1 GAL) (ATCC® MYA¬4941™) together with a yeast display vector based on pCT302 (Boder and Wittrup, Methods Enzymol. 2000; 328:430-44). The resulting fusion protein after homologous recombination in the yeast (SEQ ID NO: 325) contains a leader peptide at the N-terminus of the Aga2p protein (SEQ ID NO: 88) (Boder and Wittrup, Nat Biotechnol. 1997 June; 15(6):553-7), the protein of interest, namely the scTCR R11P3D3 (SEQ ID NO: 5) or its variants and additional peptide tags (FLAG and Myc (SEQ ID NOs 99 and 288)) to determine the expression level of the fusion protein. Libraries of scTCR variants were generated via PCR using degenerate primers and the transformation of yeast cells was performed as described in WO 2018/091396 and resulted in up to $10^9$ yeast Bones per library.

Figure 1:
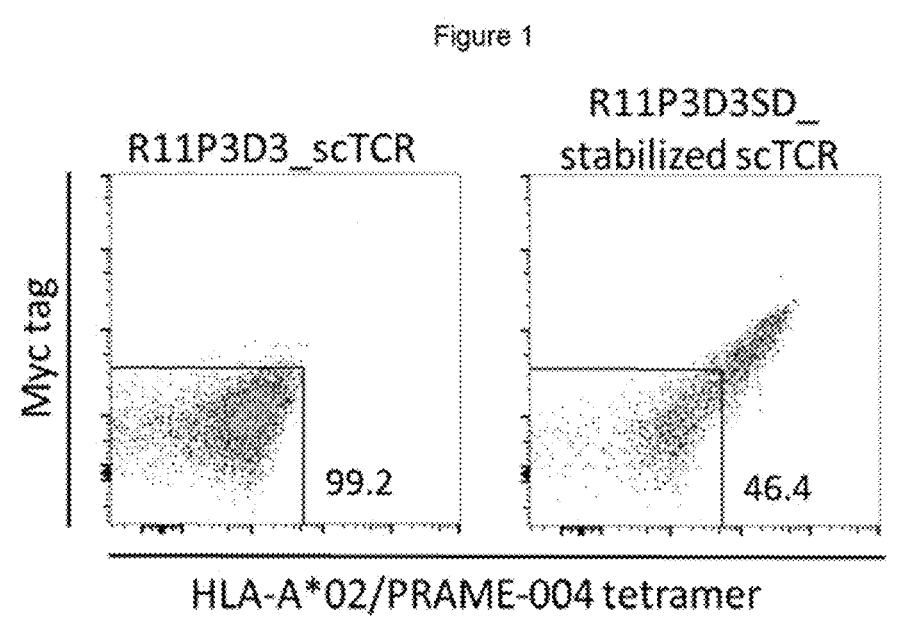

The selection process for the yeast clones bearing mutant scTCR variants with improved binding to PRAME-004 in the context of HLA-A*02 was essentially performed as described in Smith et al. (Methods Mol Biol. 2015; 1319: 95-141). Expression as determined by Myc tag-FITC staining and in particular functional binding via HLA-A*02/PRAME-004 tetramer staining was applied to select for most promising candidates (FIG. 1). The scTCR conversion by yeast surface display revealed nine framework mutations in combination with three single point CDR mutations, resulting in the stabilized scTCR R11P3D3SD (SEQ ID NO: 6) showing improved expression as well as HLA-A*02/PRAME-004 tetramer binding.

Example 1.2: Affinity Maturation of Stabilized scTCR, Binding Motif and Specificity Assessment To generate scTCR molecules with higher binding affinity towards HLA-A*02/PRAME-004, all CDRs were matured individually, using the previously identified stabilized scTCR R11P3D3SD (SEQ ID NO: 6). The CDR residues were randomized by using degenerate DNA oligo primers essentially as described previously (Smith et al, Methods Mol Biol. 2015; 1319:95-141). The resulting DNA libraries were transformed as described in example 1.

Figure 2:
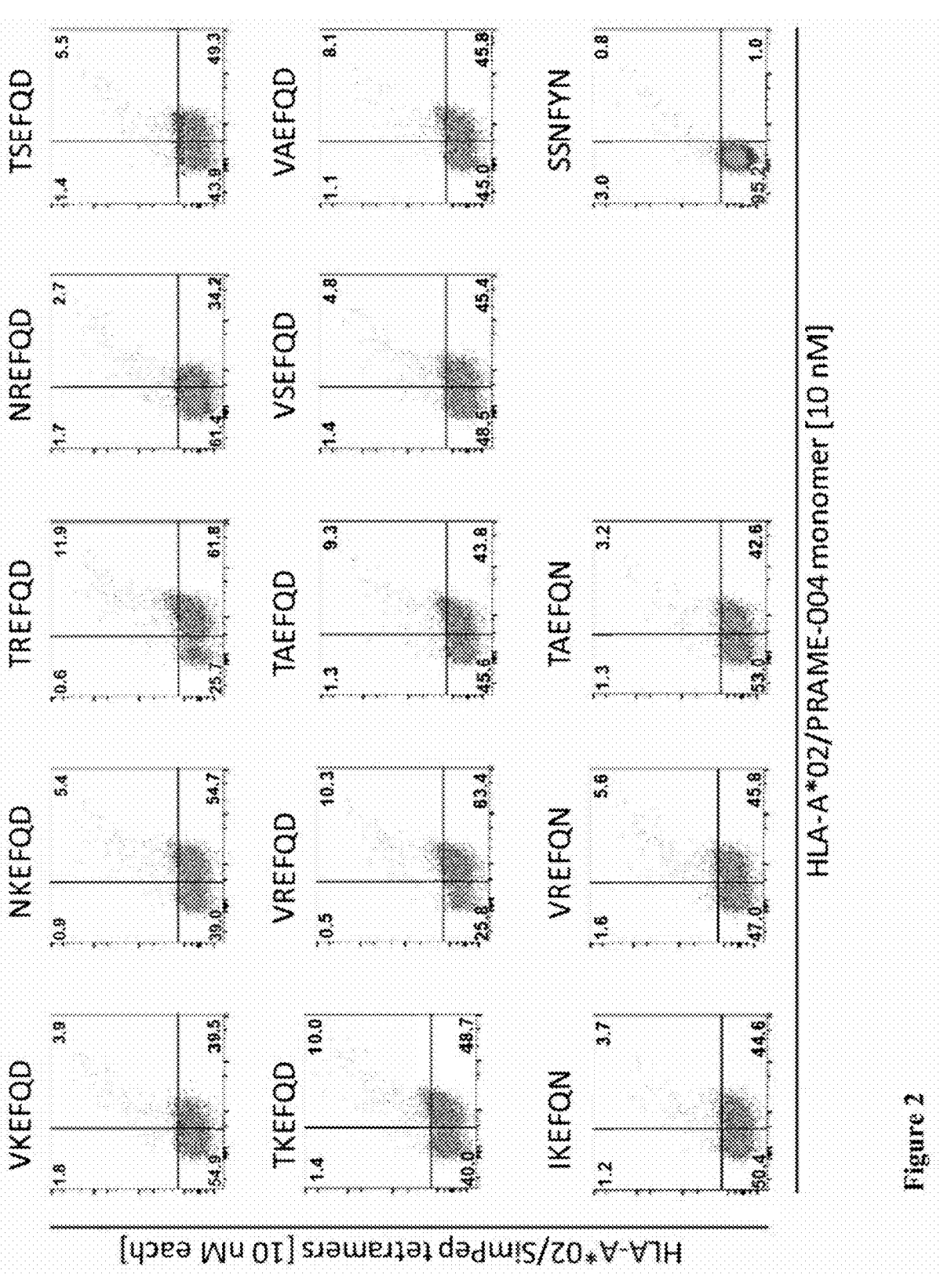
FIG. 2: Affinity maturation of scTCR CDR1 alpha vie yeast surface display. Stabilized scTCRs comprising non-modified and maturated CDR1 alpha were stained with HLA-A*02/PRAME-004 monomer at a concentration of 10 nM. Counterstaining with a mix of HLA-A*02/SimPep tetramers, each applied at a concentration of 10 nM, containing peptides (SEQ ID NO: 51 to 59) with high sequence similarity to PRAME-004 (SEQ ID NO: 50). Stabilized scTCR R11P3D3SD (SEQ ID NO: 6) with non-modified alpha chain CDR1 sequence SSNFYN (SEQ ID NO: 13, bottom right panel) is compared to scTCR variants comprising the affinity maturated alpha chain CDR1 sequences VKEFQD, NKEFQD, TREFQD, NREFQD, TSEFQD, TKEFQD, VREFQD, TAEFQD, VSEFQD, VAEFQD, IKEFQN, VREFQN and TAEFQN (SEQ ID NOs 16 to 28), respectively. SSNFYN (SEQ ID NO 13) is the corresponding CDRa1 sequence of the stabilized scTCR R11P3D3SD.

For the selection of affinity enhanced and specific R11P3D3SD scTCR variants, decreasing concentrations of HLA-A*02/PRAME-004 tetramer or monomer were used for each selection round. After four selection rounds, single scTCR clones were isolated and sequenced, resulting in a multitude of affinity matured CDR sequences. As exemplarily shown for scTCR with matured CDRa1 sequences (SEQ ID NOs: 16 to 28, FIG. 2), a strong improvement in binding of HLA-A*02/PRAME-004 monomers could also be demonstrated for scTCR with matured CDRa2 and CDRb2 (SEQ ID NOs 29 to 32 and 35 to 45, Table 3). The selectivity of HLA-A*02/PRAME-004 binding was retained during maturation as confirmed by the low binding of the scTCR to a mix of HLA-A*02 tetramers containing peptides (similar peptides or SimPeps) with high degree of sequence similarity to PRAME-004 peptide (SEQ ID NO: 50). All selected scTCR maturation variants showed substantial staining with HLA-A*02/PRAME-004 monomers at a concentration of 10 nM, while the non-maturated stabilized scTCR R11P3D3SD as reference did not show staining (FIG. 2 and Table 3). Furthermore, binding of maturated scTCR to a mix of similar peptides, applied in a high avidity format of HLA-A*02 tetramers at a concentration of 10 nM, could not be detected or showed only low signals in comparison to HLA-A*02/PRAME-004 monomer binding, which confirms the capability of the scTCR maturation variants to bind the PRAME-004 target peptide in a highly specific manner.

TABLE 3

Binding data of yeast-bearing scTCRs with mutant CDR2s. Stabilized scTCR comprising non-modified and maturated CDR2 alpha and CDF-12 beta were stained with 10 nM HLA-A*2/PRAME-004 monomer and counterstained with a mix of HLA-A*02 tetramers, each applied at a concentration of 10 nM, containing peptides (similar peptides or SimPeps, SEQ ID NO: 51 to 59) with high sequence similarity to PRAME-004 (SEQ ID NO: 50).

| | | Yeast cells stained positive with | | | | Yeast cells stained positive with | |
|---|---|---|---|---|---|---|---|
| CDRa2 | | HLA-A*02/ | HLA-A*02/ | CDRb2 | | HLA-A*02/ | HLA-A*02/ |
| Sequence | SEQ ID NO | PRAME-004, monomer | SimPep, tetramer mix | Sequence | SEQ ID NO | PRAME-004, monomer | SimPep, tetramer mix, |
| FGPYGKE | 32 | 61.0% | 8.1% | YQNTAV | 37 | 66.9% | 3.8% |
| FGPYGRE | 30 | 59.0% | 6.6% | YQNTAL | 38 | 51.6% | 3.3% |

TABLE 3-continued

Binding data of yeast-bearing scTCRs with mutant CDR2s. Stabilized scTCR comprising
non-modified and maturated CDR2 alpha and CDF-12 beta were stained with 10 nM HLA-
A*2/PRAME-004 monomer and counterstained with a mix of HLA-A*02 tetramers, each applied
at a concentration of 10 nM, containing peptides (similar peptides or SimPeps, SEQ
ID NO: 51 to 59) with high sequence similarity to PRAME-004 (SEQ ID NO: 50).

| | | Yeast cells stained positive with | | | | Yeast cells stained positive with | |
| | | HLA-A*02/ | HLA-A*02/ | | | HLA-A*02/ | HLA-A*02/ |
| CDRa2 | | PRAME-004, | SimPep, | CDRb2 | | PRAME-004, | SimPep, |
| Sequence | SEQ ID NO | monomer | tetramer mix | Sequence | SEQ ID NO | monomer | tetramer mix, |
|---|---|---|---|---|---|---|---|
| FGPYGTE | 31 | 64.5% | 10.9% | FQNTAT | 39 | 57.4% | 3.8% |
| FGPYGVE | 29 | 54.5% | 5.7% | MQNSAV | 40 | 69.2% | 4.2% |
| MTSNGDE* | 14 | 3.6% | 3.3% | FQNTAL | 41 | 62.0% | 5.5% |
| | | | | MQNTAI | 42 | 60.7% | 4.6% |
| | | | | LQNTAV | 43 | 60.5% | 3.3% |
| | | | | MQNTAV | 44 | 58.0% | 4.4% |
| | | | | YQNTAI | 35 | 51.7% | 2.9% |
| | | | | FQNTAV | 36 | 66.9% | 3.3% |
| | | | | FNNNEP* | 15 | 1.9% | 2.5% |

*corresponding CDR from R11P3D3SD_scTCR (SEQ ID NO: 6)

Figure 3:
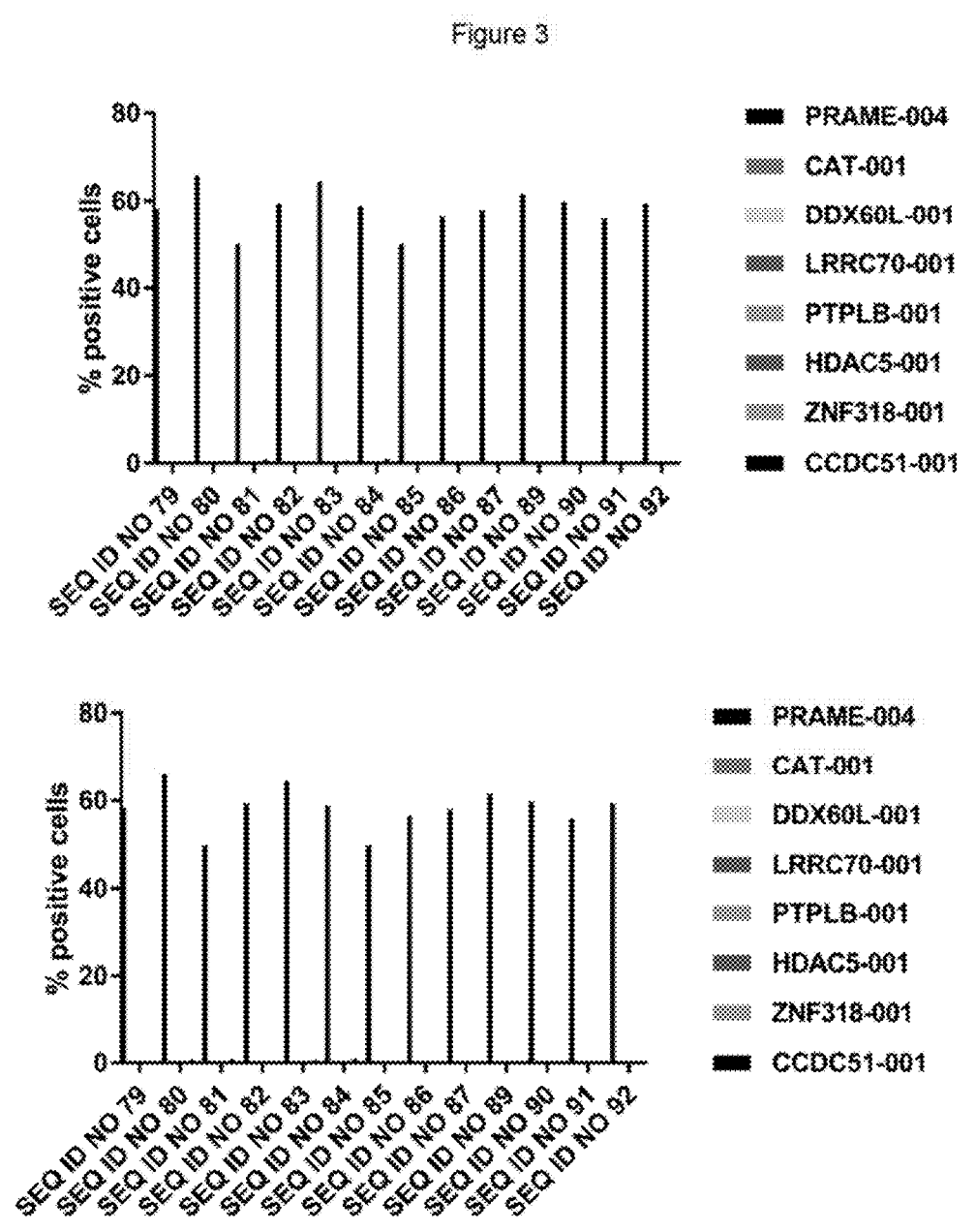
Figure 4:
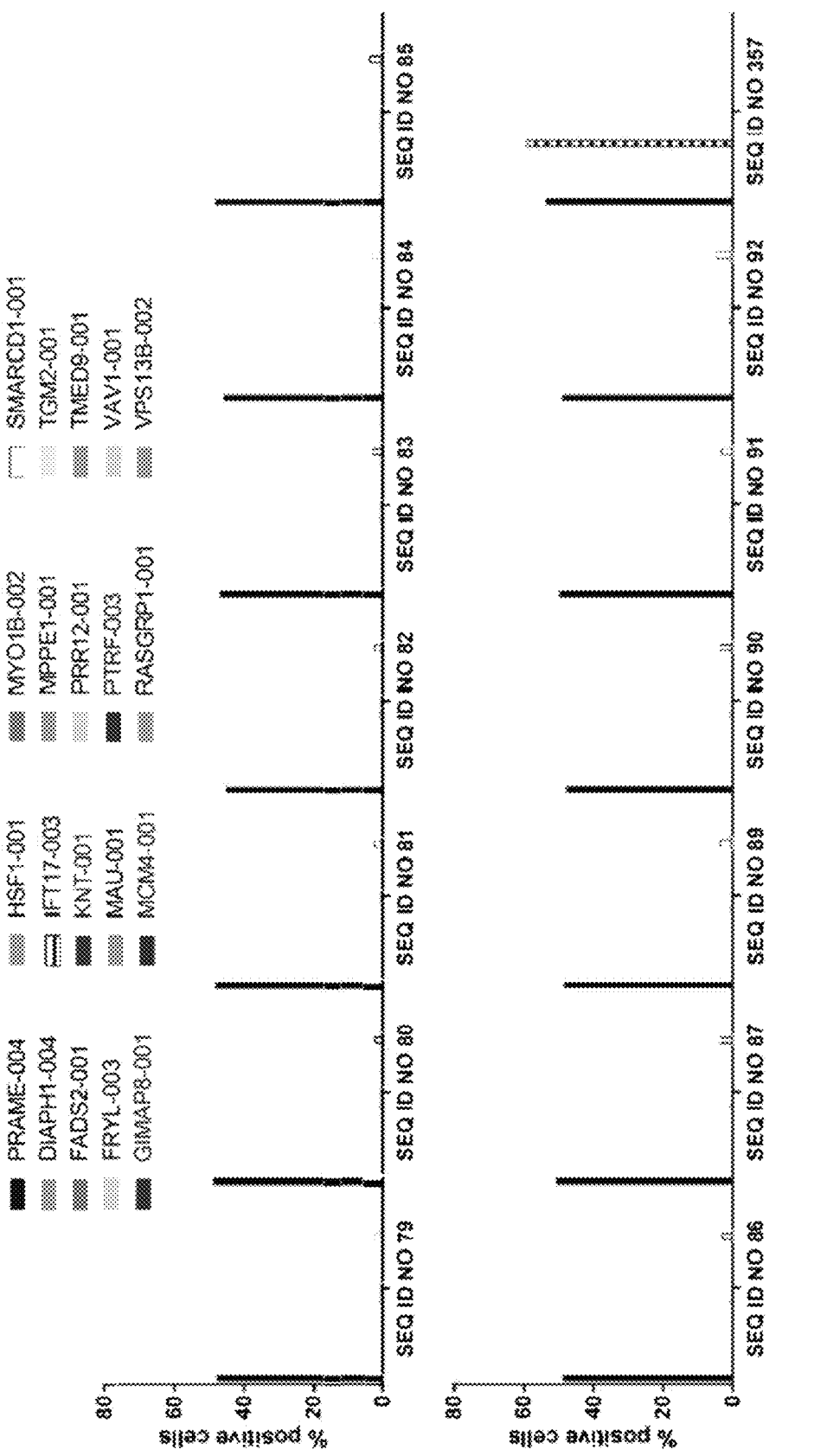
FIG. 4: Binding of high affinity scTCR yeast clones to similar peptides. Yeast clones bearing stabilized scTCRs with maturated CDRs (SEQ ID NOs: 79 to 87 and 89 to 92) were stained with 100 nM HLA-A*02 monomers containing the PRAME-004 target peptide or one out of 19 similar peptides (SEQ ID NOs 51, 57, 60, 62 to 69 and 71 to 78). R16P1C10_CDR6_scTCR (SEQ ID NO 357) was added as reference, but only binding to PRAME-004 and IFT17-003 (SEQ ID NO 60) was assessed for this done.

To further increase the affinity of scTCR clones, maturated CDRs identified in above-described CDR libraries were systematically combined in one DNA library and transformed into Saccharomyces cerevisiae EBY100 as described in example 1.1. This library was selected using HLA-A*02/PRAME-004 monomer and scTCR from single yeast clones were sequenced and analyzed regarding their binding towards HLA-A*02 monomers containing either the PRAME-004 target peptide or one peptide derived from the group of 26 peptides (similar peptides) sharing sequence similarities with PRAME-004 (SEQ ID NOs: 51-60, 62 to 69 and 71 to 78). All the selected high affinity scTCR variants (SEQ ID NOs 79 to 87 and 89 to 92) bound strongly to HLA-A*02/PRAME-004 monomer with binding $EC_{50}$ values in the low nanomolar or sub-nanomolar range (Table 4), as calculated by non-linear 4-point curve fitting. With the exception of SMARCD1-001 (SEQ ID NO: 76) that provoked a binding signal slightly above background (FIG. 4), none of the scTCR variants (SEQ ID NOs 79 to 87 and 89 to 92) exhibited binding above background levels to any of the similar peptides (SEQ ID NOs: 51-60, 62 to 69 and 71 to 78) in the context of HLA-A*02 monomers applied at a concentration of 100 nM (FIG. 3, FIG. 4. Table 4). The presented data confirm the high binding specificity of the scTCR variants with combined CDR mutations whose binding properties were superior to the reference scTCR (R16P1C10 CDR6_scTCR, SEQ ID NO 357) that showed strong binding to IFT17-003 (SEQ ID NO 60) at a level indistinguishable from PRAME-004 binding (FIG. 4).

Figure 5:
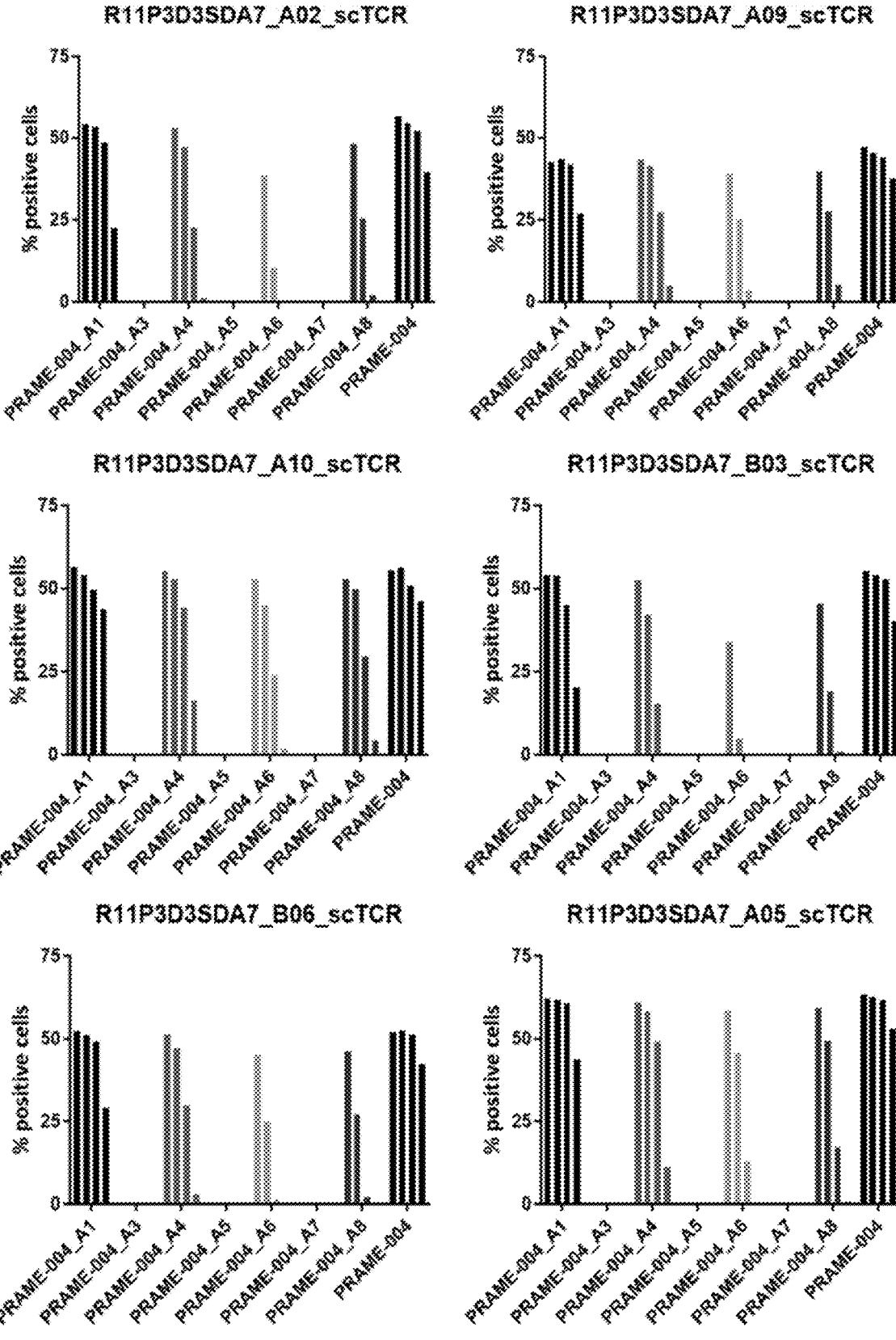
FIG. 5: Binding motif determination with high affinity scTCR yeast clones. Yeast clones bearing stabilized scTCRs with maturated CDRs (SEQ ID NOs: 79, 80, 82, 83 and 85 to 87) were stained with PRAME-004 as well as with PRAME-004 peptide variants containing alanine substitutions (SEQ ID NOs 318 to 324) in the context of HLA-A*02 applied at concentrations of 10 nM, 3 nM, 1 nM and 0.3 nM.
Figure 5:
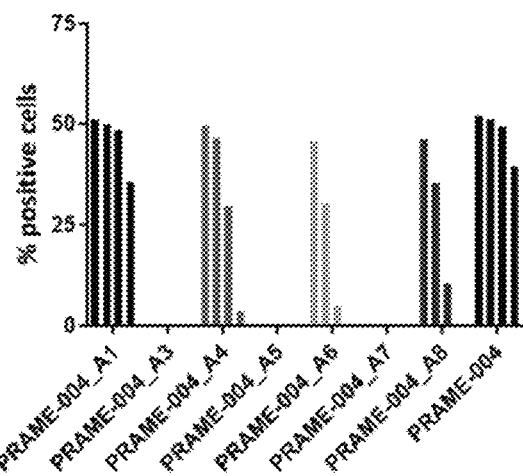

A set of selected high affinity scTCRs from yeast surface display was further examined regarding their functional epitope on the target peptide in context of the HLA-A*02 presentation, called binding motif. This was addressed by single alanine substitutions of positions 1, 3, 4, 5, 6, 7 and 8 of the PRAME-004 target peptide (SEQ ID NOs 318 to 324) and assessment of binding of scTCR-bearing yeast cells to the respective PRAME-004 peptide variants in context of HLA-A*02. Four concentrations (10 nM, 3 nM, 1 nM, 0.3 nM) of HLA-A*02 monomers with PRAME-004 or the respective alanine-substituted peptides were used to stain the high affinity scTCR-bearing yeast cells and revealed a broad binding motif for all scTCR variants with strong recognition of positions 3, 5 and 7 as confirmed by the lack of staining signals at all tested monomer concentrations. For positions 6 and 8 of the PRAME-004 peptide, a contribution to the binding motif can be assumed since alanine replacements at these positions significantly reduced the staining signals, even if this was observed with lower stringency than for the positions 3, 5 and 7. For positions 1 and 4 of the PRAME-004 peptide, only a marginal or no contribution to the binding motif could be determined since alanine substitutions resulted in staining intensities nary comparable to those observed with the PRAME-004 target peptide (FIG. 5 and Table 4).

For further analysis, the five scTCR clones R11P3D3SDA7_A02_scTCR (SEQ ID NO: 79), R11P3D3SDA7_A09_scTCR (SEQ ID NO: 82), R11P3D3SDA7_A10_scTCR (SEQ ID NO: 83), R11P3D3SDA7_B03_scTCR (SEQ ID NO: 85) and R11P3D3SDA7_B06_scTCR (SEQ ID NO: 87) were subject to conversion into scTCR-Fab bispecific format in order to determine further protein features (see following example).

TABLE 4

Binding data of yeast-bearing scTCR and soluble scTCR-Fab molecules and respective variable chain sequences. For scTCR-bearing yeast cells, binding towards HLA-A*02/PRAME-004 monomers is presented as EC50 values and binding towards 26 similar peptides (SEQ ID NOs 51 to 60. 62-69 and 71 to 79) in context of 100 nM HLA-A*02 monomer is presented as number of peptides showing no binding. Binding motif positions constituting the functional epitope of PRAME-004 were determined by alanine scanning and positions with strong and medium (positions in brackets) impact on scTCR binding are indicated. Five soluble scTCR-Fab molecules (TPP-70 to TPP-74) were assessed for binding affinity ($K_D$) towards HLA-A*02/PRAME-004 monomer and for binding towards a set of 14 similar peptides (see example 2). n.d. not determined

| Molecule name | Sequence ID NOs | FRa mutations (compared to parental TCR) | CDRa1 | CDRa2 | CDRa3 | FRb mutations (compared to parental TCR) | CDRb1 | CDRb2 | CDRb3 | scTCR on yeast cells | | soluble scTCR-Fab | | |
|---|---|---|---|---|---|---|---|---|---|---|---|---|---|---|
| | | | | | | | | | | EC50 for HLA-A*02/PRAME-004 binding [nM] | Similar peptides without binding | Binding motif positions | $K_D$ for HLA-A*02/PRAME-004 binding [nM] | Similar peptides without binding |
| R11P3D3SD_stablized_scTCR | 6 | W44K, A52F, V55Y, K92T, G93D | SSNFYN | MTSNGDE | ALYNNNDMR | L11E, Q44E, M46P, R48Q | SGHNS | FNNNEP | ASSPGSTDTQY | n.d. | n.d. | n.d. | n.d. | n.d. |
| R11P3D3SDA7_A02_scTCR and TPP-70 | 79, 93 and 94 | W44K, A52F, V55Y, K92T, G93D | TREFQD | FGPYGVE | ALYNNNDMR | L11E, Q44E, M46P, R48Q | SGHMS | FQNTAV | ASSPGSTDTQY | 0.53 | 25/26 | 3,5,7 (6.8) | 11.7 | 14/14 |
| R11P3D3SDA7_A05_scTCR | 80 | W44K, A52F, V55Y, K92T, G93D | TKEFQD | FGPYGVE | ALYNNNDMR | L11E, Q44E, M46P, R48Q | SGHNS | FQNTAV | ASSPGATDTQY | 0.28 | 25/26 | 3,5,7 (6.8) | n.d. | n.d. |
| R11P3D3SDA7_A06_scTCR | 81 | W44K, A52F, V55Y, K92T, G93D | TREFQD | FGPYGKE | ALYNNNDMR | L11E, R22H, Q44E, M46P, R48Q | SGHNS | FQNTAV | ASSPGSTDTQY | 0.33 | 25/26 | 3,5,7 (6.8) | n.d. | n.d. |
| R11P3D3SDA7_A09_scTCR and TPP-71 | 82, 93 and 95 | W44K, A52F, V55Y, K92T, G93D | TKEFQD | FGPYGRE | ALYNNNDMR | L11E, Q44E, M46P, R48Q | SGHNS | FQNTAV | ASSPGATDTQY | 0.29 | 25/26 | 3,5,7 (6.8) | 11.1 | 14/14 |
| R11P3D3SDA7_A10_scTCR and T99-72 | 83, 93 and 96 | W44K, A52F, V55Y, K92T, G93D | SSNFYN | FGPYGVE | ALYNNNDMR | L11E, Q44E, M46P, R48Q | SGHNS | FNSETV | ASSPGATDTQY | 0.4 | 25/26 | 3,5,7 (6.8) | 4.38 | 14/14 |
| R11P3D3SDA7_B01_scTCR | 84 | W44K, A52F, V55Y, K92T, G93D | NKEFQD | FGPYGVE | ALYNNNDMR | L11E, Q44E, M46P, R48Q | SGHNS | YQNTAV | ASSPGATDTQY | 0.24 | 25/26 | n.d. | n.d. | n.d. |

TABLE 4-continued

Binding data of yeast-bearing scTCR and soluble scTCR-Fab molecules and respective variable chain sequences. For scTCR-bearing yeast cells, binding towards HLA-A*02/PRAME-004 monomers is presented as EC50 values and binding towards 26 similar peptides (SEQ ID NOs 51 to 60. 62-69 and 71 to 79) in context of 100 nM HLA-A*02 monomer is presented as number of peptides showing no binding. Binding motif positions constituting the functional epitope of PRAME-004 were determined by alanine scanning and positions with strong and medium (positions in brackets) impact on scTCR binding are indicated. Five soluble scTCR-Fab molecules (TPP-70 to TPP-74) were assessed for binding affinity (K_D) towards HLA-A*02/PRAME-004 monomer and for binding towards a set of 14 similar peptides (see example 2). n.d. not determined

| Molecule name | Sequence ID NOs | FRa mutations (compared to parental TCR) | CDRa1 | CDRa2 | CDRa3 | FRb mutations (compared to parental TCR) | CDRb1 | CDRb2 | CDRb3 | scTCR on yeast cells | | | soluble scTCR-Fab | |
|---|---|---|---|---|---|---|---|---|---|---|---|---|---|---|
| | | | | | | | | | | EC50 for HLA-A*02/PRAME-004 binding [nM] | Similar peptides without binding | Binding motif positions | K_D for HLA-A*02/PRAME-004 binding [nM] | Similar peptides without binding |
| R11P3D3SDA7_B03_scTCR and TPP-73 | 85, 93 and 97 | W44K, A52F, V55Y, K92T, G93D | NKEFGD | FGPYGTE | ALYNNNDMR | L11E, Q44E, M46P, R48Q | SGHNS | FQNTAV | ASSPGSTDTQY | 0.31 | 25/26 | 3,5,7 (6.8) | 12.5 | 14/14 |
| R11P3D3SDA7_B04_scTCR | 86 | W44K, V55Y, K92T, G93D | SSNFYN | FGPYGKE | ALYNNNDMR | L11E, R22H, Q44E, M46P, R48Q | SGHNS | YQNTAI | ASSPGSTDTQY | 2.26 | 25/26 | 3,6,7 (6.8) | n.d. | n.d. |
| R11P3D3SDA7_B06_scTCR and TPP-74 | 87, 93 and 98 | W44K, A52F, V55Y, K92T, G93D | VKEFQD | FGPYGKE | ALYNNNDMR | L11E, Q44E, M46P, R48Q | SGHNS | FQNTAV | ASSPGATDTQY | 0.81 | 25/26 | 3,5,7 (6.8) | 6.41 | 14/14 |
| R11P3D3SDA7_F11_scTCR | 89 | W44K, A52F, V55Y, K92T, G93D | VKEFQD | FGPYGKE | ALYNNNDMR | H10N, R22H, L11E, Q44E, M46P, R48Q | SGHNS | FNSETV | ASSPGSTDTQY | 1.42 | 25/26 | n.d. | n.d. | n.d. |
| R11P3D3SDA7_G11_scTCR | 90 | W44K, A47D, A52F, V55Y, K92T, G93D | NKEFQD | FGPYGRE | ALYNNNDMR | L11E, R43K, Q44E, M46P, R48Q | SGHNS | YQNTAV | ASSPGATDTQY | 0.65 | 25/26 | n.d. | n.d. | n.d. |
| R11P3D3SDA7_H08_scTCR | 91 | W44K, A52F, V55Y, K92T, G93D | TREFQD | FGPYGTE | ALYNNNDMR | L11E, Q44E, M46P, R48Q | SGHNS | YQNTAV | ASSSGATDTQY | 0.67 | 26/26 | n.d. | n.d. | n.d. |
| R11P3D3SDA7_H09_scTCR | 92 | L39M, W44K, A52F, V55Y, K92T, G93D | TKEFQD | FGPYGVE | ALYNNNDMR | L11E, Q44E, M46P, R48Q | SGHNS | FQNTAV | ASSPGSTDTQY | 0.91 | 25/26 | n.d. | n.d. | n.d. |

Example 2: Production and Characterization of Soluble scTCR-Fab Molecules

TCRs consisting of Valpha and Vbeta domains were designed, produced and tested in a single-chain (scTCR) format coupled to a Fab-fragment of a humanized UCHT1-antibody (Table 5 and Table 18). Vectors for the expression of recombinant proteins were designed as mono-cistronic, controlled by HCMV-derived promoter elements, pUC19-derivatives. Plasmid DNA was amplified in E. coli according to standard culture methods and subsequently purified using commercial-available kits (Macherey & Nagel). Purified plasmid DNA was used for transient transfection of CHO cells. Transfected CHO-cells were cultured for 10-11 days at 32° C. to 37° C.

Conditioned cell supernatant was cleared by filtration (0.22 μm) utilizing Sartoclear Dynamic. Lab Filter Aid (Sartorius). Bispecific molecules were purified using an Äkta Pure 25 L FPLC system (GE Lifesciences) equipped to perform affinity and size-exclusion chromatography in line. Affinity chromatography was performed on protein L columns (GE Lifesciences) following standard affinity chromatographic protocols. Size exclusion chromatography was performed directly after elution (pH 2.8) from the affinity column to obtain highly pure monomeric protein using Superdex 200 pg 16/600 columns (GE Lifesciences) following standard protocols. Protein concentrations were determined on a NanoDrop system (Thermo Scientific) using calculated extinction coefficients according to predicted protein sequences. Concentration was adjusted, if needed, by using Vivaspin devices (Sartorius). Finally, purified molecules were stored in phosphate-buffered saline at concentrations of about 1 mg/mL at temperatures of 2-8° C. Final product yield was calculated after completed purification and formulation.

Quality of purified bispecific molecules was determined by HPLC-SEC on MabPac SEC-1 columns (5 μm, 4×300 mm) running in 50 mM sodium-phosphate pH 6.8 containing 300 mM NaCl within a Vanquish uHPLC-System.

Stress stability testing was performed by incubation of the molecules formulated in PBS for up to two weeks at 40° C. Integrity, aggregate-content as well as monomer-recovery was analyzed by HPLC-SEC analyses as described above.

TABLE 5

Summary of productivity and stress stability data obtained for scTCR-Fab molecules.

Figure 6:
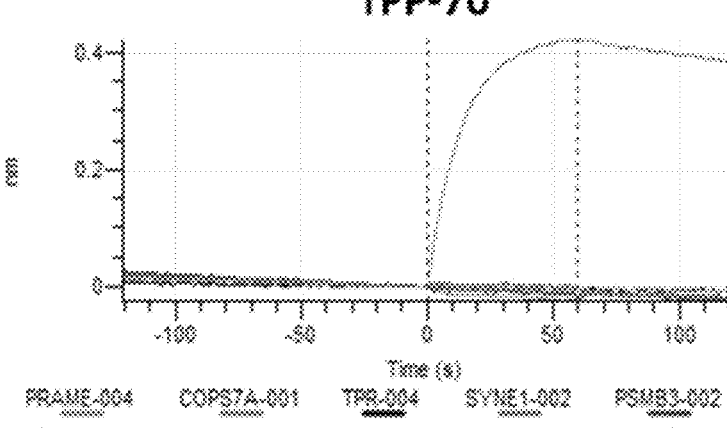
FIG. 6: Similar peptide screening for soluble scTCR-Fab molecules. Binding to 14 similar peptides (SEQ ID NOs: 187, 188, 190, 192, 194, 196, 198, 200, 202, 204, 206, 208, 210 and 212) in the context of HLA-A*02 was analyzed at a concentration of 1 μM scTCR-Fab using bio-layer interferometry. Upper curve in each graph represents scTCR-Fab binding to the target HLA-A*02/PRAME-004 monomer.
Figure 6:
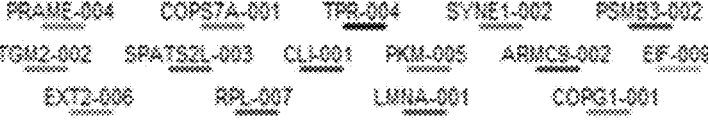
Figure 6:
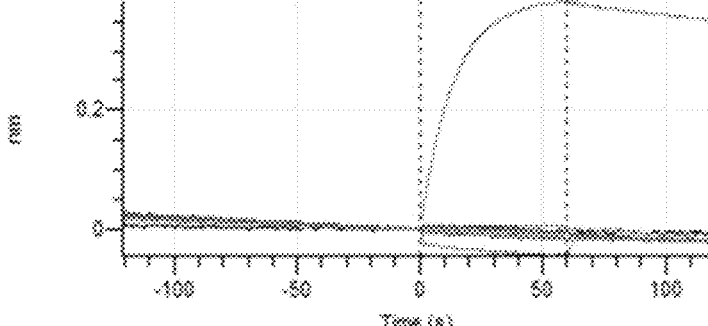
Figure 6:
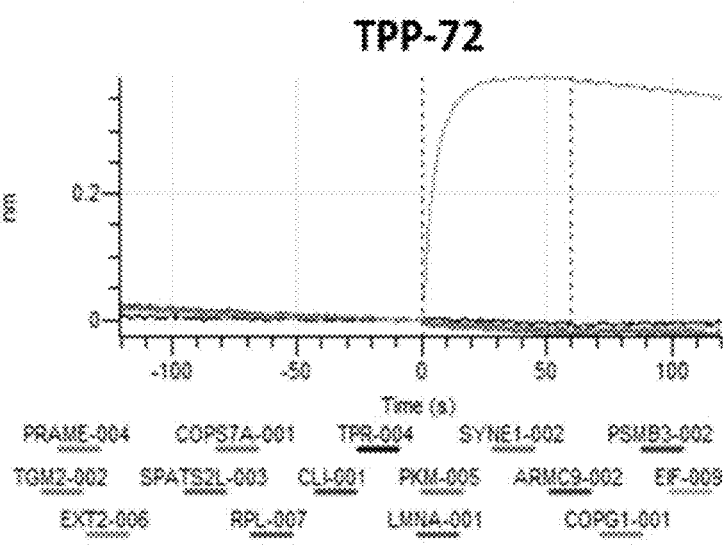
Figure 6:
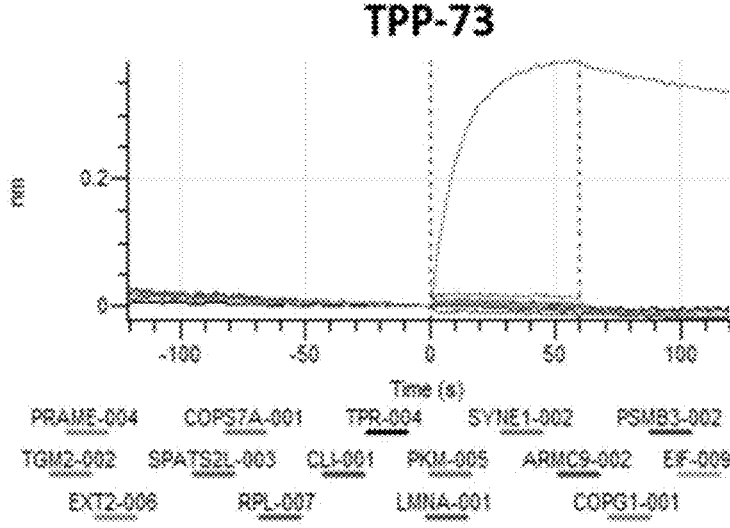
Figure 6:
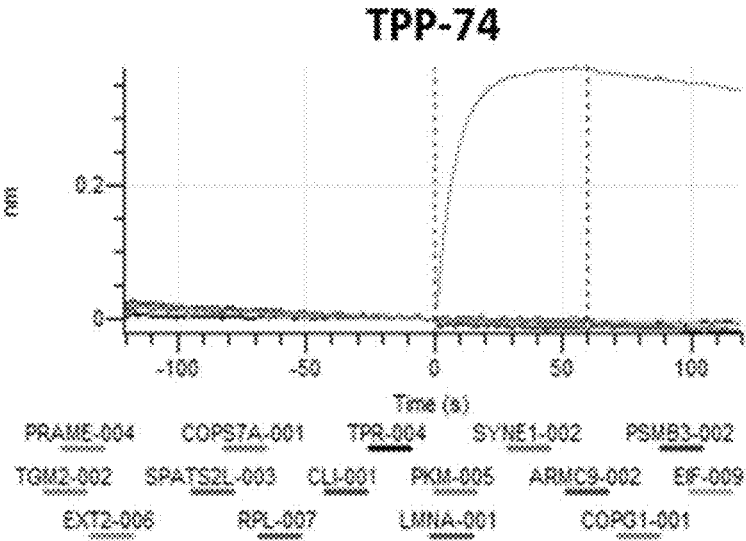

| scTCR-Fab variant | Final product yield (mg/L) | Monomer content after production (%) | Monomer content after 14 days at 40° C. (%) |
|---|---|---|---|
| TPP-70 | 14.3 | 97.12 | 87.82 |
| TPP-71 | 10.0 | 85.87 | 64.15 |
| TPP-72 | 51.4 | 98.21 | 48.41 |
| TPP-73 | 50.4 | 98.33 | 92.76 |
| TPP-74 | 78.0 | 98.89 | 95.82 | scTCR-Fab molecules TPP-70-TPP-74 were analyzed for their binding affinity to HLA-A*02 monomers containing the PRAME-004 target peptide via bio-layer interferometry. Measurements were performed on an Octet RED384 system using settings recommended by the manufacturer. Assays were run at a sensor offset of 3 mm and an acquisition rate of 5 Hz. Binding kinetics were measured at 30° C., and 1000 rpm shake speed using PBS, 0.05% Tween-20, 0.1% BSA as buffer. His-tagged HLA-A*02/PRAME-004 monomers were loaded onto HIS1K biosensors prior to analyzing serial dilutions of the scTCR-Fab molecules. Data evaluation was done using Octet Data Analysis HT Software. Strong binding affinities were determined for the scTCR-Fab molecules with $K_D$ values ranging from 4 nM to 12 nM (Table 4). Furthermore, the scTCR-Fab variants were screened for binding to 14 similar peptides (SEC ID NOs: 187, 188, 190, 192, 194, 196, 198, 200, 202, 204, 206, 208, 210 and 212). Screening with similar peptides was performed by bio-layer interferometry essentially as described above analyzing a high concentration of scTCR-Fab molecules of 1 μM to allow detection of weak binding signals. None of the maturated scTCR variants showed binding to any of the tested similar peptides (FIG. 6). The scTCR from TPP-74 was used for generation of bispecific molecules with alternative formats, such as the TCER® format.

Example 3: T Cell Engaging Receptor (TCER®) Format

Example 3.1: Production and Characterization of Soluble scTCR in Bispecific TCER® Format For construction of TCER® molecules, DNA-sequences coding for $V_H$ and $V_L$, derived from either hUCHT1(Var17), a newly humanized version of the anti-CD3 antibody UCHT1, BMA031(V36), a humanized antibody binding to TCR/CD3 complex, or the anti-CD3 antibody ID4 as well as sequences coding for and Valpha and Vbeta and respective linkers were obtained by gene synthesis. Resulting DNA-sequences were cloned in frame into expression vectors coding for hinge region, CH2 and CH3 domain derived from human IgG1 (Accession #: P01851. The CH2 and CH3 domains were engineered to contain different mutations (including N2970 mutation) to ablate binding to Fc gamma receptors and complement and to incorporate a knob-into-hole structure into CH3 domains with an additional inter-chain disulfide bond stabilization. Production, purification and characterization of TCER® molecules (Table 6, Table 18) was performed as outlined in example 2.

TABLE 6

Summary of productivity and stress stability data
obtained for TCER ® molecules.

| TCER ® variant | Va, Vb (SEQ ID NO) | Recruiter | Final product yield (mg/L) | Monomer (%) | Monomer (%) after 14 days at 40° C. |
|---|---|---|---|---|---|
| TPP-93 | 129, 130 | UCHT1-V17 | 18.8 | 94.49 | n/a |
| TPP-79 | 129, 130 | BMA031(V36) | 66.2 | 99.47 | n/a |
| TPP-105 | 129, 130 | ID4 | 54.2 | 98.50 | 97.91 |

Figure 7:
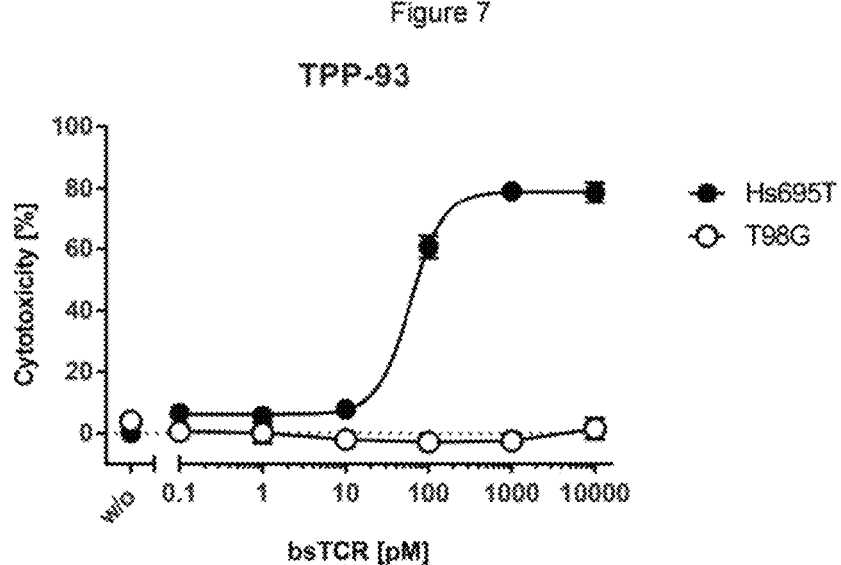
FIG. 7: In vitro cytotoxicity of TCER® molecules on target-positive and target-negative tumor cell lines. PBMC from a healthy HLA-A*02-positive donor were incubated with either target-positive tumor cell line Hs695T (●) or target-negative, but HLA-A*02-positive tumor cell line T98G (○), respectively, at a ratio of 1:10 in the presence of increasing TCER® concentrations. TCER®-induced cytotoxicity was quantified after 48 hours of co-culture by measurement of released LDH. Results for experiments assessing TPP-93 and TPP-79 are shown in the upper and lower panel, respectively.
Figure 7:
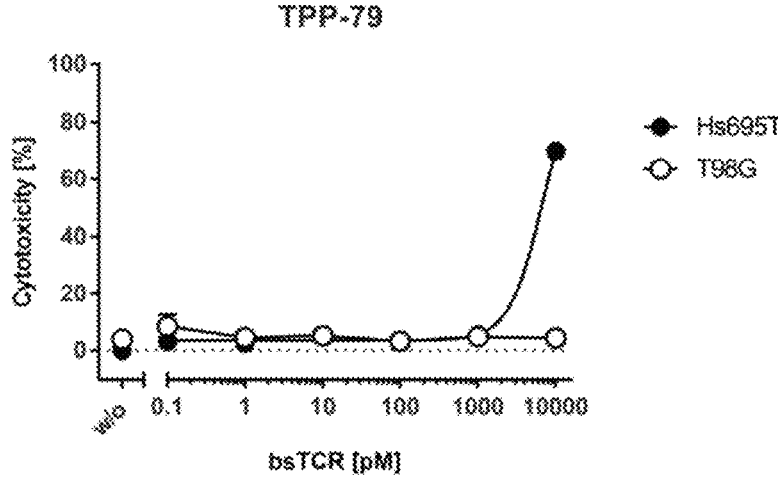
Figure 8:
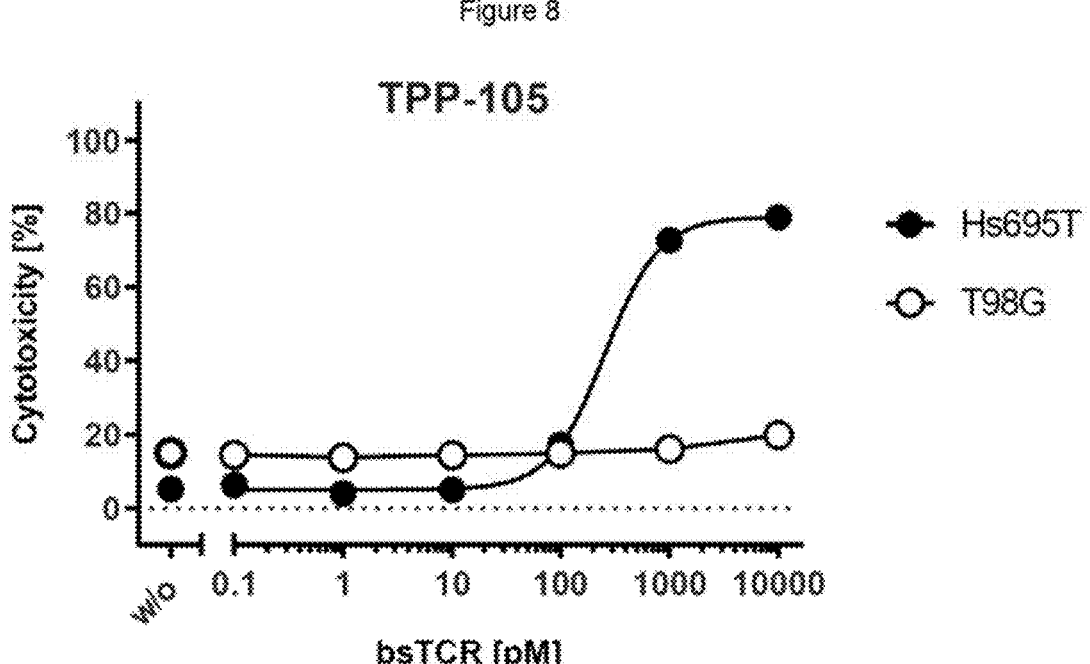
FIG. 8: In vitro cytotoxicity of TCER® molecule TPP-105 on target-positive and target-negative tumor cell lines. PBMC from a healthy HLA-A*02-positive donor were incubated with either target-positive tumor cell line Hs695T (●) or target-negative, but HLA-A*02-positive tumor cell line T98G (○), respectively, at a ratio of 1:10 in the presence of increasing concentrations of TPP-105. TCER®-induced cytotoxicity was quantified after 48 hours of co-culture by measurement of released LDH.

Functionality of TCER® molecules, with respect to killing of an HLA-A*02-positive tumor cell line presenting PRAME-004 target peptide on their cell surface (e.g. Hs695T), was assessed in LDH-release assays. In addition, an HLA-A*02-positive but PRAME-004-negative tumor cell line (e.g. T98G) was assessed to characterize unspecific or off-target activity of the TCER® variants. Tumor cell lines were co-incubated with PBMC from a healthy HLA-A*02-positive donor at a ratio of 1:10 in the presence of increasing TCER® concentrations. TCER®-induced cytotoxicity was quantified after 48 hours of co-culture by measurement of released LDH. $EC_{50}$ values of dose-response curves were calculated utilizing non-linear 4-point curve fitting. Results representative for 3 TCER® molecules (Table 6, Table 18) are shown in FIG. 7 and FIG. 8. The results demonstrate that all 3 TCER® molecules utilizing different recruiting antibody domains are functional and induce T cell-mediated cytotoxicity in a strictly PRAME-004 dependent manner.

Example 3.2: Slot I

TCER® molecules were constructed utilizing VH and VL domains derived from hUCHT1(Var17) or BMA031(V36) as well as Valpha and Vbeta as described above (example 3.1). Production, purification and characterization of TCER® molecules (Table 7, Table 18) was performed as outlined in example 2.

TABLE 7

Summary of productivity and stress stability data obtained
for TCER ® molecules of slot I.

| TCER ® variant | Recruiter | Final product yield (mg/L) | Monomer (%) | Monomer (%) after 14 days at 40° C. |
|---|---|---|---|---|
| TPP-106 | UCHT1-V17 | 2.92 | 96.97 | 94.11 |
| TPP-108 | UCHT1-V17 | 4.30 | 95.44 | 94.10 |
| TPP-109 | BMA031(V36) | 34.00 | 97.8 | 93.82 |
| TPP-110 | BMA031(V36) | 50.00 | 97.12 | 92.70 |
| TPP-111 | BMA031(V36) | 61.30 | 98.04 | 94.46 |

TABLE 7-continued

Summary of productivity and stress stability data obtained
for TCER ® molecules of slot I.

| TCER ® variant | Recruiter | Final product yield (mg/L) | Monomer (%) | Monomer (%) after 14 days at 40° C. |
|---|---|---|---|---|
| TPP-112 | UCHT1-V17 | 2.47 | 96.75 | 92.71 |
| TPP-113 | UCHT1-V17 | 2.24 | 97.79 | 95.95 |
| TPP-114 | UCHT1-V17 | 2.64 | 97.68 | 95.37 |
| TPP-115 | UCHT1-V17 | 1.80 | 97.84 | 94.15 |
| TPP-116 | UCHT1-V17 | 3.26 | 97.54 | 94.13 |
| TPP-117 | UCHT1-V17 | 3.02 | 97.29 | 94.33 |
| TPP-118 | UGHT1-V17 | 2.13 | 98.09 | 95.11 |
| TPP-119 | UCHT1-V17 | 3.04 | 97.56 | 95.18 |
| TPP-120 | UCHT1-V17 | 2.58 | 97.57 | 94.52 |
| TPP-121 | UCHT1-V17 | 2.74 | 97.92 | 92.80 |
| TPP-122 | UCHT1-V17 | 3.22 | 96.9 | 92.77 |
| TPP-123 | UCHT1-V17 | 2.48 | 97.16 | 92.62 |
| TPP-124 | UCHT1-V17 | 2.68 | 96.38 | 90.73 |
| TPP-125 | UCHT1-V17 | 2.48 | 96.56 | 92.33 |
| TPP-126 | UCHT1-V17 | 1.76 | 96.71 | 90.62 |
| TPP-127 | UCHT1-V17 | 2.68 | 96.37 | 90.95 |
| TPP-128 | UCHT1-V17 | 1.81 | 97.25 | 90.44 |
| TPP-129 | UCHT1-V17 | 1.47 | 96.94 | 89.55 |

TCER® Slot I variants TPP-106, TPP-108-TPP-129 were analyzed for their binding affinity to the target peptide-HLA complex (HLA-A*02/PRAME-004) via bio-layer interferometry. Measurements were performed on an Octet RED384 system as described above. Strong binding affinities were determined with $K_D$ values ranging from 3 nM to 10 nM (Table 8). These data show the additional affinity-improving effects of TCR mutations bA84D and aN114V, while mutations bT115L/K, bL11E, bP46M, bQ48R, aN20K do not seem to affect binding affinity. Furthermore, binding affinities were determined for three selected similar peptides serving as potential off-target peptides in the context of HLA-A*02 and $K_D$ windows were calculated compared to binding of the target peptide-HLA. Strongest TCER® binding to similar peptides was observed for GIMAP8-001 with $K_D$ windows ranging from 26- to 168-fold. $K_D$ windows of more than 25-fold already provide good therapeutic windows.

TABLE 8

$K_D$ values for binding of TCER ® Slot I variants to HLA-A*02/PRAME-004 and $K_D$ windows for three
selected similar peptides serving as potential off-target peptides as measured via bio-layer interferometry.

| TCER ® variant | Recruiter | PRAME-004 $K_D$ (M) | $K_D$(GIMAP8-001)/ $K_D$(PRAME-004) | $K_D$(SMARCD1-001)/ $K_D$(PRAME-004) | $K_D$(MYO1B-002)/ $K_D$(PRAME-004) |
|---|---|---|---|---|---|
| TPP-108 | UCHT1-V17 | 1.03E−08 | 168 | no binding | no binding |
| TPP-112 | UCHT1-V17 | 4.68E−09 | 39 | 380 | no binding |
| TPP-106 | UCHT1-V17 | 4.08E−09 | 42 | 272 | no binding |
| TPP-110 | BMA031(V36) | 1.33E−08 | Not analyzed | Not analyzed | Not analyzed |
| TPP-111 | BMA031(V36) | 4.98E−09 | Not analyzed | Not analyzed | Not analyzed |
| TPP-109 | BMA031(V36) | 4.45E−09 | Not analyzed | Not analyzed | Not analyzed |
| TPP-113 | UCHT1-V17 | 5.24E−09 | 33 | 322 | no binding |
| TPP-114 | UCHT1-V17 | 5.68E−09 | 37 | 225 | no binding |

TABLE 8-continued $K_D$ values for binding of TCER ® Slot I variants to HLA-A*02/PRAME-004 and $K_D$ windows for three selected similar peptides serving as potential off-target peptides as measured via bio-layer interferometry.

| TCER ® variant | Recruiter | PRAME-004 $K_D$ (M) | $K_D$(GIMAP8-001)/ $K_D$(PRAME-004) | $K_D$(SMARCD1-001)/ $K_D$(PRAME-004) | $K_D$(MYO1B-002)/ $K_D$(PRAME-004) |
|---|---|---|---|---|---|
| TPP-115 | UCHT1-V17 | 5.06E−09 | 38 | 221 | no binding |
| TPP-116 | UCHT1-V17 | 5.18E−09 | 31 | 205 | no binding |
| TPP-117 | UCHT1-V17 | 3.42E−09 | 34 | 41 | no binding |
| TPP-118 | UCHT1-V17 | 3.29E−09 | 49 | 51 | no binding |
| TPP-119 | UCHT1-V17 | 4.57E−09 | 30 | 213 | no binding |
| TPP-120 | UCHT1-V17 | 5.49E−09 | 28 | 324 | no binding |
| TPP-121 | UCHT1-V17 | 5.41E−09 | 26 | 98 | no binding |
| TPP-122 | UCHT1-V17 | 4.43E−09 | 31 | 174 | no binding |
| TPP-123 | UGHT1-V17 | 3.63E−09 | 28 | 33 | no binding |
| TPP-124 | UCHT1-V17 | 3.43E−09 | 30 | 32 | no binding |
| TPP-125 | UCHT1-V17 | 5.98E−09 | 18 | 248 | no binding |
| TPP-126 | UCHT1-V17 | 5.37E−09 | 41 | 221 | no binding |
| TPP-127 | UGHT1-V17 | 5.24E−09 | 34 | 195 | no binding |
| TPP-128 | UCHT1-V17 | 3.75E−09 | 40 | 52 | no binding |
| TPP-129 | UCHT1-V17 | 3.05E−09 | 40 | 47 | no binding |

Example 3.3: Slot II

Further TCER® molecules were constructed utilizing VH and VL domains derived from BMA031(V36) or ID4 as well as Valpha and Vbeta as described above (example 3.1). Production, purification and characterization of the respective TCER® molecules (Table 9, Table 18) was performed as outlined in example 2 whereby all ID4-based molecules were purified using MAbSelect SuRE columns (GE Life-sciences).

TABLE 9

Summary of productivity and stress stability data obtained for TCER ® molecules of slot II.

| Protein | Recruiter | Final product yield (mg/L) | Monomer (%) | Monomer (%) after 14 days at 40° C. |
|---|---|---|---|---|
| TPP-207 | BMA031(V36) | 31.8 | 98.92 | 95.22 |
| TPP-208 | BMA031(V36) | n/a | 96.96 | 92.61 |
| TPP-209 | BMA031(V36) | 32.2 | 98.87 | 94.79 |
| TPP-210 | BMA031(V36) | 19.6 | 98.15 | 92.35 |
| TPP-211 | BMA031(V36) | 44.8 | 98.60 | 96.35 |
| TPP-212 | BMA031(V36) | 34.4 | 97.66 | 98.53 |
| TPP-213 | BMA031(V36) | 53.2 | 98.12 | 92.45 |
| TPP-214 | BMA031(V36) | 45.2 | 98.26 | 92.08 |
| TPP-215 | BMA031(V36) | 33.8 | 99.21 | 95.15 |
| TPP-216 | BMA031(V36) | 4.5 | 96.53 | 85.24 |
| TPP-217 | BMA031(V36) | 26.0 | 98.16 | 93.87 |
| TPP-218 | BMA031(V36) | 19.8 | 98.24 | 94.49 |
| TPP-219 | ID4 | >22.8 | 71.07 | 36.49 |
| TPP-220 | ID4 | 21.8 | 98.36 | 94.94 |
| TPP-221 | ID4 | 49.2 | 97.80 | 96.51 |
| TPP-222 | ID4 | 45.4 | 98.23 | 95.79 |
| TPP-227 | ID4 | 48.2 | 97.60 | 93.67 |
| TPP-228 | ID4 | 12.1 | 97.55 | 94.30 |
| TPP-229 | ID4 | 45.6 | 97.22 | 96.99 |
| TPP-230 | ID4 | 47.4 | 97.29 | 97.07 |

TCER® Slot II variants TPP-207-TPP-222 and TPP-227-TPP-230 were analyzed for their binding affinity to the target peptide-HLA complex (HLA-A*02/PRAME-004) via bio-layer interferometry. Measurements were performed on an Octet RED384 system as described above. Strong binding affinities were determined with $K_D$ values ranging from 1 nM to 7 nM (Table 10). Higher binding affinities were observed for the Identical TCR variants (i.e. Identical $V_A$ and $V_B$) in combination with the ID4 recruiter when compared to combination with the BMA031(V36) recruiter (TPP-219-TPP-222 vs. TPP-211-TPP-214). As observed for the TCER® molecules from Slot I (example 3.2), the affinity-improving effects of TCR mutations bA84D and aN114Y could be confirmed for the TCER® variants generated in Slot II, while again no effects on affinity were found for the mutations bT115L/K, bP46M, bQ48R, aN20K.

TCR binding motifs were assessed for selected TCER® molecules. To determine binding motifs, affinities were measured for the target peptide-HLA complex (HLA-A*02/PRAME-004) as well as for complexes with PRAME-004 variants carrying alanine-substitutions at peptide positions 1, 3, 4, 5, 6, 7 or 8. Affinity measurements were performed on an Octet RED384 or HTX system as described above. PRAME-004 positions were considered to be part of the TCR binding motif if an at least 2-fold reduction in binding affinity or signal (measured for the highest concentration analyzed) was detected for the alanine-substituted peptide variants. All TCER® variants showed broad binding motifs recognizing at least four peptide PRAME-004 positions (Table 10).

TABLE 10

$K_D$ values for binding of TCER ® Slot II variants to HLA-A*02/PRAME-004 and binding motif determination according to $K_D$ windows for Ala-substituted PRAME-004 peptide variants as measured via bio-layer interferometry. For the A5 peptide, the $K_D$ window was set to 100-fold since no to very low binding precluded affinity determination.

| TCER ® variant | Recruiter | PRAME-004 $K_D$ (M) | PRAME-004 $K_D$ (M), for motif | Binding motif | Fold $K_D$ window (Ala/PRAME-004) A1 | A3 | A4 | A5 | A6 | A7 | A8 |
|---|---|---|---|---|---|---|---|---|---|---|---|
| TPP-207 | BMA031(V36) | 4.33E−09 | | | | | | | | | |
| TPP-208 | BMA031(V36) | 3.40E−09 | | | | | | | | | |
| TPP-209 | BMA031(V36) | 3.29E−09 | 5.88E−09 | -x3-5678x | 1.1 | 16.0 | 1.2 | 100.0 | 4.3 | 33.4 | 2.4 |
| TPP-210 | BMA031(V36) | 3.41E−09 | | | | | | | | | |
| TPP-211 | BMA031(V36) | 4.53E−09 | | | | | | | | | |
| TPP-212 | BMA031(V36) | 2.86E−09 | | | | | | | | | |
| TPP-213 | BMA031(V36) | 4.55E−09 | 4.92E−09 | -x3-5678x | 1.1 | 13.4 | 1.3 | 100.0 | 4.3 | 32.3 | 2.6 |
| TPP-214 | BMA031(V36) | 3.29E−09 | 2.76E−09 | -x3-5-78x | 1.3 | 3.0 | 1.2 | 100.0 | 2.0 | 5.4 | 2.2 |
| TPP-215 | BMA031(V36) | 4.65E−09 | | | | | | | | | |
| TPP-216 | BMA031(V36) | 3.38E−09 | | | | | | | | | |
| TPP-217 | BMA031(V36) | 4.22E−09 | | | | | | | | | |
| TPP-218 | BMA031(V36) | 2.51E−09 | | | | | | | | | |
| TPP-219 | ID4 | 3.40E−09 | | | | | | | | | |
| TPP-220 | ID4 | 1.85E−09 | | | | | | | | | |
| TPP-221 | ID4 | 2.28E−09 | 2.61E−09 | -x3-5678x | 1.1 | 11.0 | 1.2 | 100.0 | 4.1 | 24.2 | 3.2 |
| TPP-222 | ID4 | 1.47E−09 | 1.30E−09 | -x3-5678x | 1.4 | 2.9 | 1.2 | 100.0 | 2.2 | 5.5 | 2.1 |
| TPP-227 | ID4 | 6.89E−09 | | | | | | | | | |
| TPP-228 | ID4 | 3.46E−09 | | | | | | | | | |
| TPP-229 | ID4 | 6.48E−09 | | | | | | | | | |
| TPP-230 | ID4 | 2.93E−09 | 2.63E−09 | -x3-5678x | 1.3 | 13.0 | 1.9 | 100.0 | 3.9 | 26.7 | 3.3 |

Example 3.4: Slot IIa

Based on the data generated for the previous TCER® variants (example 3.3), new variants were generated carrying systematic substitutions of selected TCR amino acid positions for which a positive effect on protein properties or binding properties could be detected in previous experiments. Production, purification and characterization of the respective TCER® molecules (Table 11 and Table 18) was performed as outlined in example 3.3. Productivity and stress stability data are summarized in Table 11.

TABLE 11

Summary of productivity and stress stability data obtained for TCER ® molecules of slot IIa.

| TCER ® variant | Recruiter | Final product yield (mg/L) | Monomer (%) | Monomer (%) after 14 days at 40° C. |
|---|---|---|---|---|
| TPP-235 | BMA031(V36) | 40.4 | 98.12 | 96.16 |
| TPP-236 | BMA031(V36) | 48.5 | 98.34 | 98.08 |
| TPP-237 | BMA031(V36) | 55.0 | 97.98 | 98.21 |
| TPP-238 | BMA031(V36) | 37.8 | 98.21 | 98.15 |
| TPP-239 | BMA031(V36) | 27.4 | 98.19 | 97.22 |
| TPP-240 | BMA031(V36) | 44.2 | 98.68 | 95.72 |
| TPP-241 | BMA031(V36) | 42.8 | 98.45 | 98.02 |
| TPP-242 | BMA031(V36) | 23.6 | 98.82 | 98.54 |
| TPP-243 | BMA031(V36) | 44.8 | 98.81 | 98.10 |
| TPP-244 | BMA031(V36) | 22.6 | 98.21 | 98.27 |
| TPP-245 | BMA031(V36) | 59.2 | 98.81 | 98.32 |
| TPP-246 | BMA031(V36) | 4.7 | 92.20 | 79.35 |
| TPP-247 | BMA031(V36) | 2.7 | 93.80 | 82.82 |
| TPP-248 | BMA031(V36) | 2.4 | 92.07 | 80.49 |
| TPP-249 | BMA031(V36) | 3.0 | 92.38 | 81.45 |
| TPP-250 | BMA031(V36) | 3.8 | 93.10 | 79.11 |
| TPP-252 | BMA031(V36) | 5.6 | 93.86 | 80.14 |
| TPP-253 | BMA031(V36) | 3.7 | 94.86 | 86.09 |
| TPP-254 | BMA031(V36) | 3.0 | 94.66 | 81.85 |
| TPP-255 | BMA031(V36) | 12.0 | 92.40 | 82.01 |
| TPP-256 | BMA031(V36) | 12.5 | 97.34 | 92.67 |
| TPP-257 | BMA031(V36) | 8.2 | 95.27 | 85.31 |
| TPP-258 | BMA031(V36) | 5.1 | 96.50 | 84.32 |

TABLE 11-continued

Summary of productivity and stress stability data obtained for TCER ® molecules of slot IIa.

| TCER ® variant | Recruiter | Final product yield (mg/L) | Monomer (%) | Monomer (%) after 14 days at 40° C. |
|---|---|---|---|---|
| TPP-259 | BMA031(V36) | 2.4 | 97.31 | 88.55 |
| TPP-260 | BMA031(V36) | 2.6 | 96.69 | 86.45 |
| TPP-261 | BMA031(V36) | 7.9 | 97.37 | 91.72 |
| TPP-262 | BMA031(V36) | 6.6 | 96.71 | 91.53 |
| TPP-263 | BMA031(V36) | 3.6 | 93.72 | 86.61 |
| TPP-264 | BMA031(V36) | 3.3 | 93.25 | 82.35 |
| TPP-265 | BMA031(V36) | 9.9 | 91.87 | 83.48 |
| TPP-266 | BMA031(V36) | 8.6 | 95.67 | 90.72 |
| TPP-267 | BMA031(V36) | 6.0 | 94.51 | 85.97 |
| TPP-266 | BMA031(V36) | 0.9 | 93.64 | 87.21 |
| TPP-269 | BMA031(V36) | 0 | n/a | n/a |
| TPP-270 | BMA031(V36) | 1.7 | 97.30 | 91.83 |
| TPP-271 | BMA031(V36) | 2.2 | 95.13 | 87.69 |
| TPP-272 | BMA031(V36) | 2.9 | 95.16 | 87.63 |
| TPP-220 | ID4 | 5.9 | 97.36 | 94.81 |
| TPP-273 | ID4 | 5.2 | 97.77 | 92.43 |
| TPP-274 | ID4 | 2.6 | 97.11 | 95.06 |
| TPP-275 | ID4 | 2.2 | 96.47 | 94.08 |
| TPP-276 | ID4 | 1.8 | 97.02 | 95.39 |
| TPP-277 | ID4 | 2.7 | 96.84 | 94.89 |
| TPP-279 | ID4 | 5.4 | 98.03 | 95.9 |

TCER® Slot IIa variants TPP-235-250, -252-268, -270-277, -279 were analyzed for their binding affinity to the target peptide-HLA complex (HLA-A*02/PRAME-004) via bio-layer interferometry. Measurements were performed on an Octet RED384 or HTX system as described above. Strong binding affinities were found with $K_D$ values ranging from 2 nM to 15 nM (Table 12). For position bA84, amino acid substitutions showed that bA84D is the most preferred substitution. At position aN114, alternative amino acid substitutions with affinities comparable to aN114Y were found, such as A, H, I and L. Alternatives to bT115K/L with comparable affinities were identified and included R, A, I and V. Introducing the mutation bA110S slightly reduced the affinities of the respective variants.

Binding motifs were assessed for selected TCER® variants. To determine binding motifs, affinities were measured for the target peptide-HLA complex (HLA-A*02/PRAME-004) as well as for complexes with PRAME-004 variants carrying alanine substitutions at peptide positions 1, 3, 4, 5, 6, 7 or 8 as described above. PRAME-004 positions were considered to be part of the TCR binding motif if an at least 2-fold reduction in binding affinity or signal (measured for the highest concentration analyzed) was detected for the alanine-substituted peptide variants. All tested TCER® variants showed broad binding motifs recognizing at least three peptide positions (Table 12).

In addition to binding motifs, the binding specificity of selected TCER® Slot II and IIa variants was further analyzed by bio-layer interferometry for binding to a set of 16 similar peptides potentially serving as off-target peptides. Measurements were performed on an Octet HTX system basically as described above. For the analysis, peptide-HLA complexes comprising the PRAME-004 target peptide, individual peptides out of a set of similar peptides or a control peptide were loaded onto HIS1K biosensors and binding of the TCER® variants was analyzed at a high TCER® concentration of 1 μM. The response signal at the end of a 5 min association phase was used to calculate the relative binding signal of the similar peptides in comparison to the PRAME-004 target peptide for selected TCER® variants (Table 13). Under these conditions, even binding events with very low affinity, which can be described as non significant (e.g. binding with a $K_D$ that is increased by a factor of $\geq 25$, $\geq 30$, $\geq 40$, $\geq 50$, $\geq 75$, or $\geq 100$, compared to the $K_D$ for binding to the PRAME-004 peptide:MHC complex), will be detected. Among the 16 analyzed similar peptides, 11 peptides did not show any binding to any of the selected TCER® variants. Binding with lower signals compared to PRAME-004 was detected for five of the 16 similar peptides and four of these peptides were analyzed in more detail for TCER® Slot III variants such as measuring $K_D$ windows compared to the PRAME-004 target peptide.

TABLE 12

$K_D$ values for binding of TCER ® Slot II variants to HLA-A*02/PRAME-004 and binding motif determination according to $K_D$ windows for Ala-substituted PRAME-004 peptide variants as measured via bio-layer interferometry. For the A5 peptide, the $K_D$ window was set to 100-fold since no to low binding precluded affinity determination.

| TCER ® variant | Recruiter | PRAME-004 $K_D$ (M) | PRAME-004 $K_D$ (M) for motif | Binding motif | Fold $K_D$ window (Ala/PRAME-004) | | | | | | |
|---|---|---|---|---|---|---|---|---|---|---|---|
| | | | | | A1 | A3 | A4 | A5 | A6 | A7 | A8 |
| TPP-246 | BMA031(V36) | 5.19E−09 | | | | | | | | | |
| TPP-247 | BMA031(V36) | 8.94E−09 | | | | | | | | | |
| TPP-248 | BMA031(V36) | 1.46E−08 | | | | | | | | | |
| TPP-249 | BMA031(V36) | 6.69E−09 | | | | | | | | | |
| TPP-250 | BMA031(V36) | 6.38E−09 | | | | | | | | | |
| TPP-252 | BMA031(V36) | 6.30E−09 | | | | | | | | | |
| TPP-220 | ID4 | 1.92E−09 | | | | | | | | | |
| TPP-273 | ID4 | 2.78E−09 | | | | | | | | | |
| TPP-274 | ID4 | 4.61E−09 | | | | | | | | | |
| TPP-275 | ID4 | 7.21E−09 | | | | | | | | | |
| TPP-276 | ID4 | 2.93E−09 | | | | | | | | | |
| TPP-277 | ID4 | 3.71E−09 | | | | | | | | | |
| TPP-279 | ID4 | 2.18E−09 | | | | | | | | | |
| TPP-212 | BMA031(V36) | 3.38E−09 | 3.48E−09 | -x3-5-7-x | 1.1 | 2.5 | 1.0 | 100.0 | 1.8 | 4.6 | 1.9 |
| TPP-235 | BMA031(V36) | 3.65E−09 | | | | | | | | | |
| TPP-236 | BMA031(V36) | 6.01E−09 | | | | | | | | | |
| TPP-237 | BMA031(V36) | 4.46E−09 | | | | | | | | | |
| TPP-238 | BMA031(V36) | 4.74E−09 | | | | | | | | | |
| TPP-239 | BMA031(V36) | 2.60E−09 | 3.44E−09 | -x3-5-7-x | 1.1 | 4.1 | 1.0 | 100.0 | 2.0 | 7.8 | 1.9 |
| TPP-240 | BMA031(V36) | 3.48E−09 | | | | | | | | | |
| TPP-241 | BMA031(V36) | 3.38E−09 | 3.84E−09 | -x3-567-x | 1.0 | 6.7 | 1.0 | 100.0 | 2.1 | 13.8 | 2.0 |
| TPP-242 | BMA031(V36) | 5.23E−09 | | | | | | | | | |
| TPP-243 | BMA031(V36) | 4.05E−09 | | | | | | | | | |
| TPP-244 | BMA031(V36) | 4.90E−09 | | | | | | | | | |
| TPP-245 | BMA031(V36) | 4.41E−09 | | | | | | | | | |
| TPP-253 | BMA031(V36) | 3.43E−09 | | | | | | | | | |
| TPP-254 | BMA031(V36) | 3.69E−09 | | | | | | | | | |
| TPP-255 | BMA031(V36) | 6.13E−09 | | | | | | | | | |
| TPP-256 | BMA031(V36) | 3.12E−09 | 4.08E−09 | -x3-5-7-x | 1.0 | 2.9 | 0.9 | 100.0 | 1.8 | 6.4 | 1.8 |
| TPP-257 | BMA031(V36) | 3.52E−09 | | | | | | | | | |
| TPP-258 | BMA031(V36) | 4.79E−09 | | | | | | | | | |
| TPP-259 | BMA031(V36) | 4.80E−09 | | | | | | | | | |
| TPP-260 | BMA031(V36) | 4.31E−09 | | | | | | | | | |
| TPP-261 | BMA031(V36) | 3.45E−09 | | | | | | | | | |
| TPP-262 | BMA031(V36) | 3.29E−09 | 4.18E−09 | -x3-5-7-x | 1.0 | 3.3 | 0.8 | 100.0 | 1.8 | 6.5 | 1.7 |
| TPP-263 | BMA031(V36) | 3.87E−09 | | | | | | | | | |
| TPP-264 | BMA031(V36) | 7.39E−09 | | | | | | | | | |
| TPP-265 | BMA031(V36) | 6.72E−09 | | | | | | | | | |
| TPP-266 | BMA031(V36) | 3.81E−09 | 4.57E−09 | -x3-5678x | 1.1 | 8.1 | 1.3 | 100.0 | 2.7 | 10.3 | 2.3 |
| TPP-267 | BMA031(V36) | 4.78E−09 | | | | | | | | | |
| TPP-268 | BMA031(V36) | 6.00E−09 | | | | | | | | | |

TABLE 12-continued $K_D$ values for binding of TCER ® Slot II variants to HLA-A*02/PRAME-004 and
binding motif determination according to $K_D$ windows for Ala-substituted PRAME-004 peptide
variants as measured via bio-layer interferometry. For the A5 peptide, the $K_D$ window
was set to 100-fold since no to low binding precluded affinity determination.

| TCER ® variant | Recruiter | PRAME-004 $K_D$ (M) | PRAME-004 $K_D$ (M) for motif | Binding motif | Fold $K_D$ window (Ala/PRAME-004) A1 | A3 | A4 | A5 | A6 | A7 | A8 |
|---|---|---|---|---|---|---|---|---|---|---|---|
| TPP-270 | BMA031(V36) | 5.74E−09 | | | | | | | | | |
| TPP-271 | BMA031(V36) | 4.08E−09 | | | | | | | | | |
| TPP-272 | BMA031(V36) | 4.11E−09 | 5.70E−09 | -x3-5678x | 1.2 | 6.9 | 1.1 | 100.0 | 2.4 | 9.8 | 2.6 |

TABLE 13

Relative binding signals for similar peptides (in percent of signals detected for PRAME-004 target
peptide) of selected TCER ® Slot II and IIa variants as measured via bio-layer interferometry.

| Peptide | TPP-214 Recruiter: BMA031 (V36) | TPP-230 Recruiter: ID4 | TPP-239 Recruiter: BMA031 (V36) | TPP-241 Recruiter: BMA031 (V36) | TPP-256 Recruiter: BMA031 (V36) | TPP-266 Recruiter: BMA031 (V36) |
|---|---|---|---|---|---|---|
| PRAME-004 | 100 | 100 | 100 | 100 | 100 | 100 |
| SMARCD1-001 | 82 | 60 | 65 | 60 | 49 | 19 |
| GIMAP8-001 | 70 | 46 | 55 | 56 | 38 | −3 |
| FARSA-001 | 69 | 35 | 49 | 72 | 17 | −5 |
| NOMAP-3-1408 | 46 | 11 | 24 | 25 | 7 | −12 |
| VIM-009 | 41 | 10 | 28 | 24 | 10 | 11 |
| buffer control | 0 | 1 | 0 | 0 | 1 | 0 |
| FAM114A2-002 | −11 | −7 | −5 | −4 | −3 | −6 |
| PDCD10-004 | −12 | −10 | −14 | −14 | −14 | −13 |
| NOMAP-5-0765 | −14 | −12 | −18 | −16 | −17 | −18 |
| IGHD-002 | −15 | −12 | −15 | −15 | −10 | −15 |
| TSN-001 | −16 | −12 | −17 | −18 | −17 | −18 |
| NOMAP-3-1587 | −16 | −14 | −16 | −17 | −18 | −18 |
| DDX5-001 (negative control) | −17 | −13 | −16 | −17 | −17 | −16 |
| ALOX15B-003 | −18 | −15 | −15 | −19 | −14 | −17 |
| NOMAP-3-1768 | −18 | −16 | −19 | −19 | −21 | −19 |
| GPR56-002 | −18 | −14 | −19 | −19 | −17 | −19 |
| NOMAP-3-1265 | −18 | −13 | −16 | −20 | −15 | −20 |
| NOMAP-3-0972 | −22 | −17 | −22 | −23 | −20 | −23 |

Example 3.5: Slot III

Further TCER® were constructed utilizing VH and VL domains derived from BMA031(V36) or modified variants (A02 and D01) thereof, or 104 as well as Valpha and Vbeta as described above (example 3.1). An additional TCER® molecule based on the UCHT1-V17 recruiting antibody (TPP-1109) was generated as reference. DNA constructs coding for the respective molecules were generated as outlined above. Resulting plasmids were used for transfection of CHO-S cells by electroporation (MaxCyte) for transient expression and production of TCER® variants (Table 14 and Table 18). Purification, formulation and initial characterization of molecules was performed as outlined above in example 3.3.

TABLE 14

Summary of productivity and stress stability data obtained
for TCER ® molecules of slot III.

| TCER ® variant | Va, Vb (SEQ ID NO) | Recruiter | Final product yield (mg/L) | Monomer (%) | Monomer (%) after 14 days at 40° C. |
|---|---|---|---|---|---|
| TPP-230 | 132, 135 | ID4 | 73.8 | 98.83 | 95.13 |
| TPP-871 | 137, 135 | ID4 | 80.0 | 98.92 | 97.33 |
| TPP-222 | 132, 134 | ID4 | 70.6 | 98.80 | 97.46 |
| TPP-872 | 137, 134 | ID4 | 62.5 | 98.77 | 97.87 |
| TPP-214 | 132, 134 | BMA31(V36) | 36.2 | 97.94 | 94.98 |
| TPP-876 | 137, 134 | ID4 | 36.9 | 97.94 | 92.28 |
| TPP-666 | 132, 136 | BMA31(V36)A02 | 49.7 | 97.59 | 93.11 |
| TPP-879 | 137, 134 | BMA31(V36)A02 | 43.5 | 92.98 | 90.42 |
| TPP-891 | 137, 134 | BMA31(V36)D01 | 40.0 | 98.18 | 94.94 |
| TPP-669 | 132, 136 | BMA31(V36)D01 | 72.9 | 97.83 | 94.66 |

TABLE 14-continued

Summary of productivity and stress stability data obtained
for TCER ® molecules of slot III.

| TCER ® variant | Va, Vb (SEQ ID NO) | Recruiter | Final product yield (mg/L) | Monomer (%) | Monomer (%) after 14 days at 40° C. |
|---|---|---|---|---|---|
| TPP-894 | 132, 135 | BMA31(V36)D01 | 40.2 | 97.45 | 93.11 |
| TPP-1109 | (CDR6) | UCHT1-V17 | 13.6 | 98.10 | 92.62 |

Figure 9:
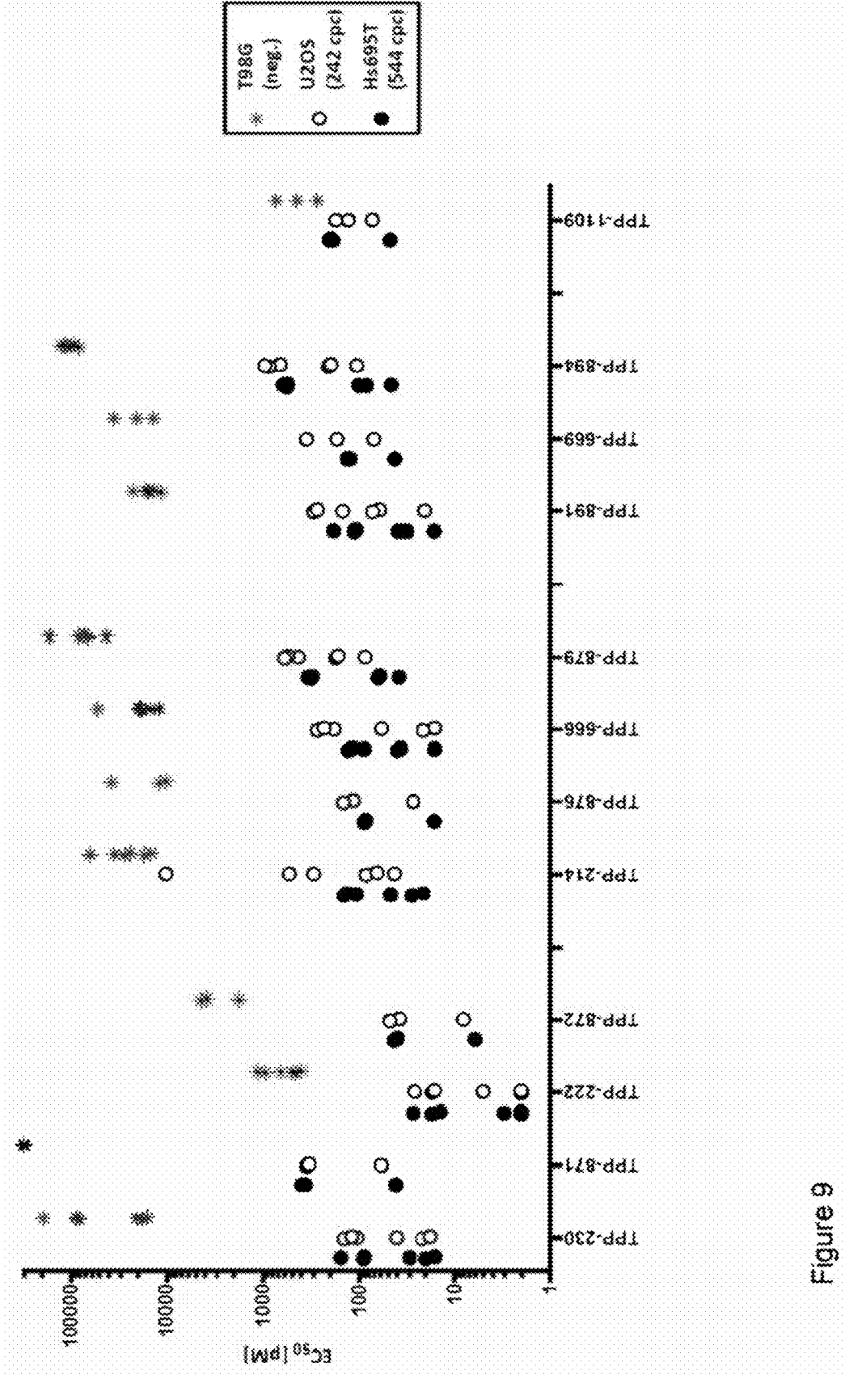
FIG. 9: Summary of cytotoxicity data of TCER® Slot III molecules. $EC_{50}$ values of dose-response curves obtained in LDH-release assays were calculated utilizing non-linear 4-point curve fitting. For each assessed TCER®-molecule calculated $EC_{50}$ values on target-positive tumor cell lines Hs695T (●), U2OS (○), and target-negative but HLA-A*02-positive tumor cell line T98G (*) are depicted. Thereby, each symbol represents one assay utilizing PBMC derived from various HLA-A*02-positive donors. For TPP-8711T980, the $EC_{50}$ is estimated, as T98G was not recognized by TPP-871.

Potency of TCER® molecules with respect to killing of HLA-A*02-positive tumor cell lines presenting different levels of PRAME-004 target peptide on their cell surface, was assessed in LDH-release assays. In addition, an HLA-A*02-positive but PRAME-004-negative tumor cell line (e.g. T98G) was assessed to characterize unspecific or off-target activity of the TCER® variants. Tumor cell lines were co-incubated with PBMC effectors derived from healthy HLA-A*02-positive donors at a ratio of 1:10 and in the presence of increasing TCER® concentrations. TCER®-induced cytotoxicity was quantified after 48 hours of co-culture by measurement of released LDH. $EC_{50}$ values of dose-response curves were calculated utilizing non-linear 4-point curve fitting. $EC_{50}$ values for two PRAME-004-positive tumor cell lines (Hs695T and U2OS) and a PRAME-004-negative tumor cell line (T98G) were determined in different experiments with different PBMC donors and are graphically summarized in FIG. 9.

TCER® Slot III variants TPP-214, -222, -230, -666, -669, -871, -872, -876, -879, -891, 894 were analyzed for their binding affinity to the target peptide-HLA complex (HLA-A*02/PRAME-004) via bio-layer interferometry. Measurements were performed on an Octet HTX system at 30° C. Assays were run at a sensor offset of 3 mm and an acquisition rate of 5 Hz on HIS1K biosensors in 16-channel mode using PBS, 0.05% Tween-20, 0.1% BSA as assay buffer. The following assay step sequence was repeated to measure all binding affinities: regeneration (5 s. 10 mM glycine pH 1.5)/neutralization (5 s, assay buffer; one regeneration cycle consists of four repeats of regeneration/neutralization), baseline (60 s, assay buffer), loading (120 s, 10 µg/ml peptide-HLA), baseline (120 s, assay buffer), association (300 s, twofold serial dilution of TCER's ranging from 100 nM to 1.56 nM or 50 nM to 0.78 nM, assay buffer as reference), dissociation (300 s, assay buffer). Data evaluation was done using Octet Data Analysis HT Software. Reference sensor subtraction was performed to subtract potential dissociation of peptide-HLA loaded onto the biosensor (via a biosensor loaded with peptide-HLA measured in buffer). Data traces were aligned to baseline (average of the last 5 s), inter-step correction was done to the dissociation step, Savitzky-Golay filtering was applied and curves were fitted globally using a 1:1 binding model (with Rmax unlinked by sensor). Strong binding affinities were found with $K_D$ values ranging from 2 nM to 5 nM (Table 15). Furthermore, binding affinities were determined for four previously identified potential off-target peptides and $K_D$ windows were calculated compared to binding of the target peptide-HLA. Measurements were performed on an Octet RED384 or HTX system at 30° C. Assays were run at a sensor offset of 3 mm and an acquisition rate of 5 Hz on HIS1K biosensors in 16-channel mode using PBS, 0.05% Tween-20, 0.1% BSA as assay buffer. The following assay step sequence was repeated to measure all binding affinities: regeneration (5 s, 10 mM glycine pH 1.5)/neutralization (5 s, assay buffer; one regeneration cycle consists of four repeats of regeneration/neutralization), baseline (60 s, assay buffer), loading (120 s, 10 µg/ml peptide-HLA), baseline (120 s, assay buffer), association (300 s, twofold serial dilution of TCER® ranging from 500 nM to 7.81 nM, assay buffer as reference), dissociation (300 s, assay buffer). Data evaluation was done using Octet Data Analysis HT Software. Reference sensor subtraction was performed to subtract potential dissociation of peptide-HLA loaded onto the biosensor (via a biosensor loaded with the respective peptide-HLA measured in buffer). Data traces were aligned to baseline (average of the last 5 s), inter-step correction was done to the dissociation step, Savitzky-Golay filtering was applied and curves were fitted globally using a 1:1 binding model (with Rmax unlinked by sensor). Overall, considerable weaker binding to the potential off-target peptides compared to target peptide was found for all variants showing windows of at least 60-fold to even no binding at all. NOMAP-3-1408 was not selected for $K_D$ determination, despite showing relative binding signals comparable to VIM-009 (Table 13). For VIM-009, the smallest measured $K_D$ windows were >100-fold (Table 15). Thus, binding to VIM-009 is not relevant and affinity determination of NOMAP-3-1408 binding was not considered necessary based on its binding signals comparable to VIM-009. For one interaction, a $K_D$ window of 50-fold was calculated. However, for this interaction and also several others, the Rmax value calculated by the fitting algorithm was too low, so that the interaction is assumed to be weaker than calculated and thus the window larger. Respective interactions are indicated in Table 15. To further analyze specificity of the different variants, binding motifs were determined by measuring the affinities for the target peptide-HLA complex as well as for the alanine-substituted variants for positions 1, 3, 4, 5, 6, 7, 8. Measurements were performed on an Octet HTX system at 30° C. Assays were run at a sensor offset of 3 mm and an acquisition rate of 5 Hz on HIS1K biosensors in 16- or 8-channel mode using PBS, 0.05% Tween-20, 0.1% BSA as assay buffer. The following assay step sequence was repeated to measure all binding affinities: regeneration (5 s, 10 mM glycine pH 1.5)/neutralization (5 s, assay buffer; one regeneration cycle consists of four repeats of regeneration/neutralization), baseline (60 s, assay buffer), loading (120 s, 10 µg/ml peptide-HLA), baseline (120 s, assay buffer), association (150 s, twofold serial dilution of TCER® ranging from 400 nM to 6.25 nM, assay buffer as reference), dissociation (300 s, assay buffer). Data evaluation was done using Octet Data Analysis HT Software. Reference sensor subtraction was performed to subtract potential dissociation of peptide-HLA loaded onto the biosensor (via a biosensor loaded with the respective peptide-HLA measured in buffer). Data traces were aligned to baseline (average of the last 5 s), inter-step correction was done to the dissociation step, Savitzky-Golay filtering was applied and curves were fitted globally using a 1:1 binding model (with Rmax unlinked by sensor). A position was considered part of the binding motif for an at least 2-fold reduction in affinity or binding signal (measured for the highest concentration analyzed). All tested TCER® variants showed broad binding motifs recognizing at least four and up to all analyzed peptide positions (Table 16). Positive effects on the binding motif were observed for bA84, aN114L and bA110S/bT115A, which is in accordance with previous data. For comparison, the binding motif of an alternative PRAME-004-targeting TCER® reference molecule (TPP-1109) was analyzed. This TCER® recognized positions 5-8 of the peptide and thus binding is limited to this peptide stretch, while positions recognized by TCER® Slot III variants are more evenly distributed throughout the whole peptide.

Figure 10:
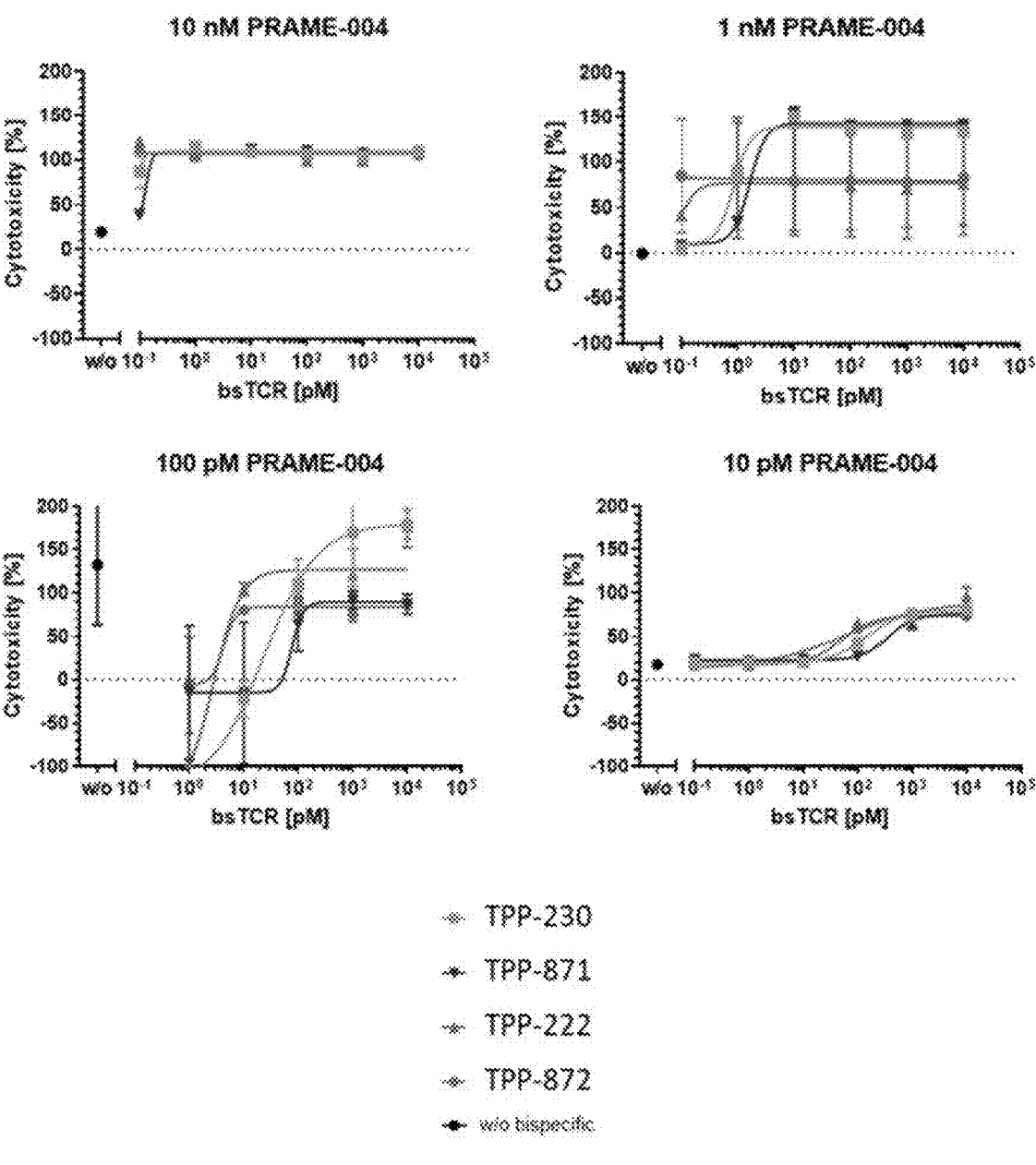
FIG. 10: In vitro cytotoxicity of TCER® Slot III variants on T2 cells loaded with different concentrations of target peptide. Cytotoxicity was determined by quantifying LDH released into the supernatants. Human PBMC were used as effector cells at an E:T ratio of 5:1. Read out was performed after 48 h.
Figure 10:
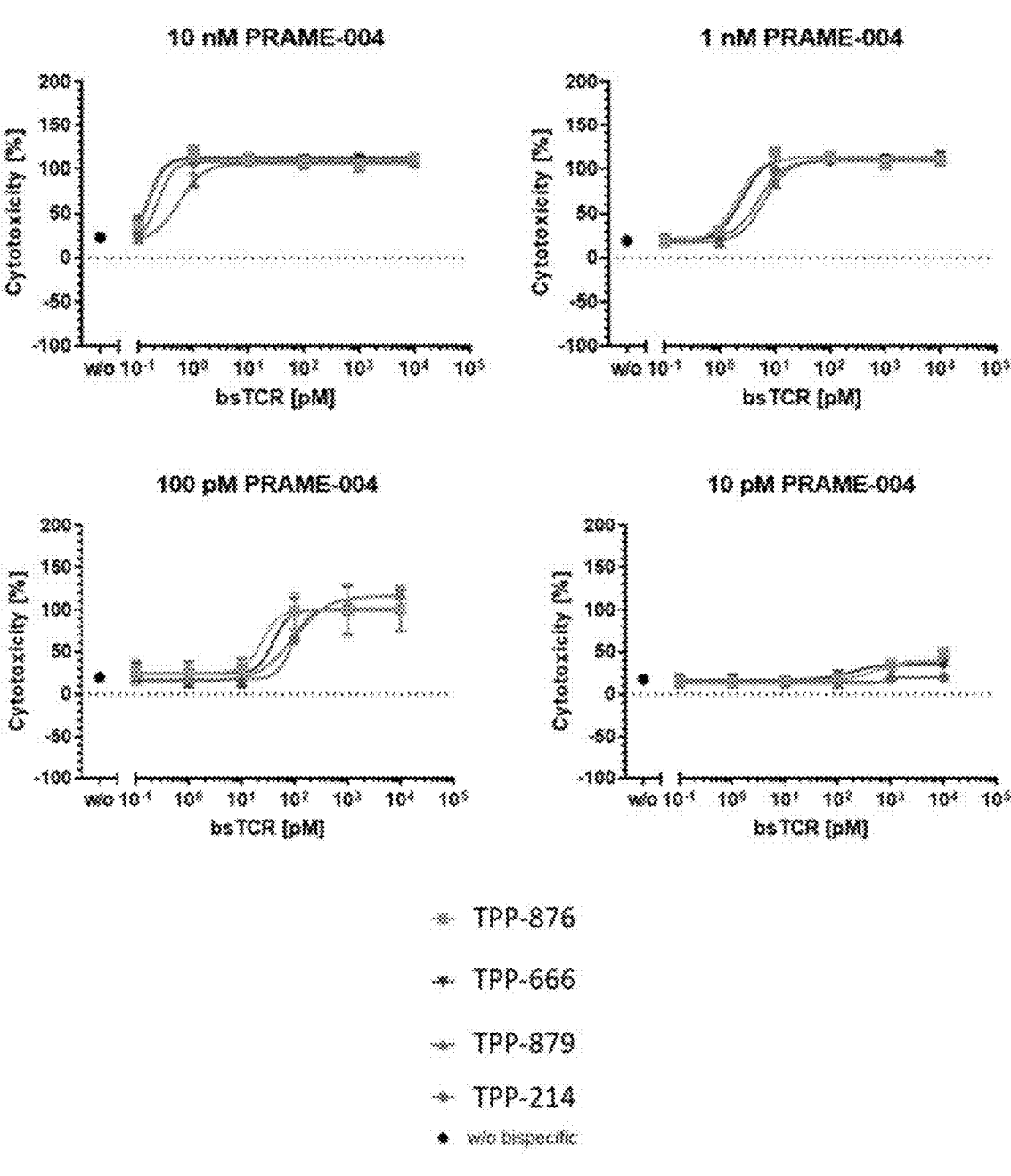
Figure 10:
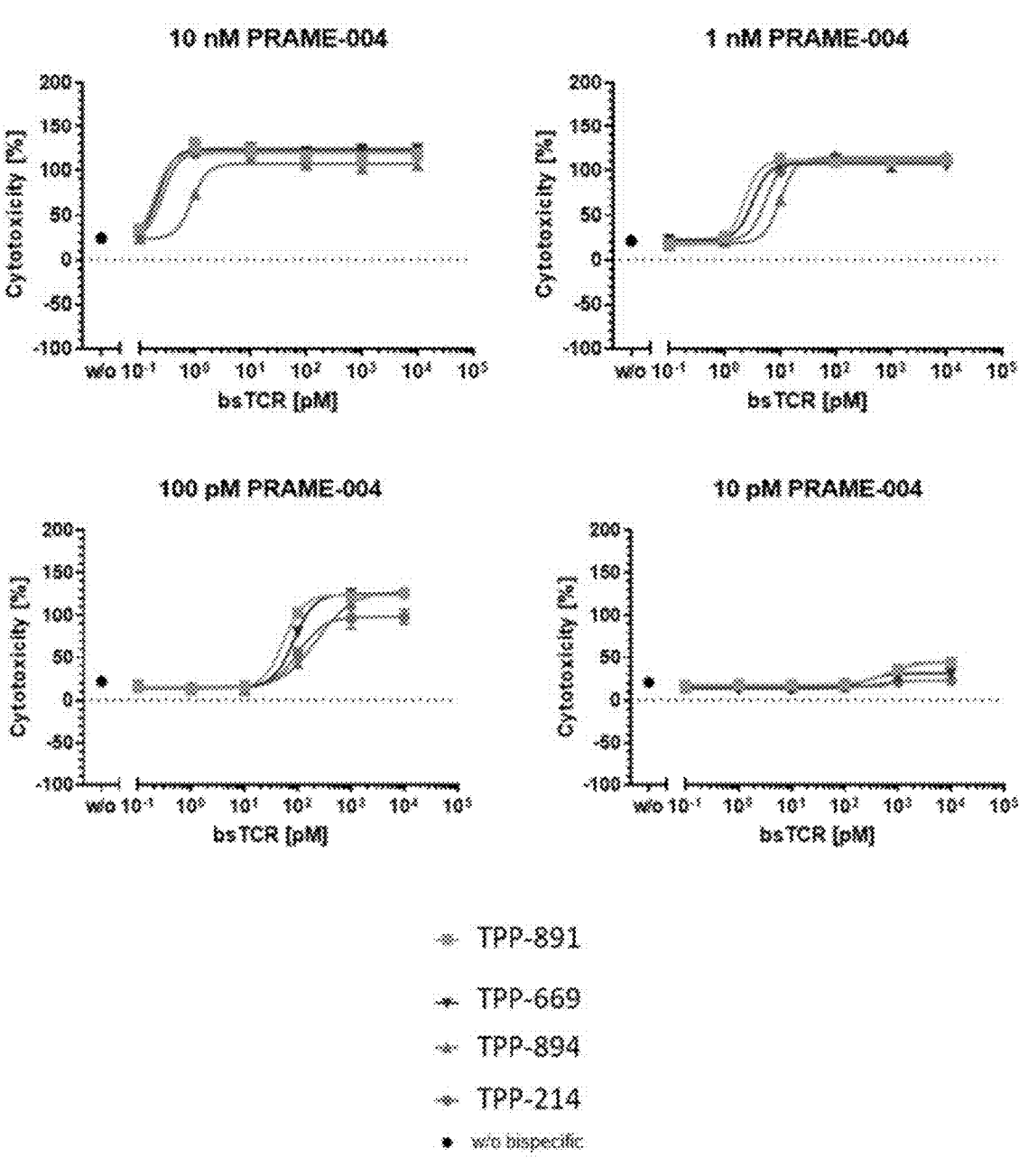

TCER® Slot III variants TPP-214, -222, -230, -666, -669, -871, -872, -876, -879, -891, 894 were additionally characterized for their ability to kill T2 cells loaded with varying levels of target peptide. After loading of the T2 cells with the respective concentrations of PRAME-004 for 2 h, peptide-loaded T2 cells were co-cultured with human PBMCs at an E:T ratio of 5:1 in the presence of increasing concentrations of TCER® variants for 48 h. Levels of LDH released into the supernatant were quantified using CytoTox 96 Non-Radioactive Cytotoxicity Assay Kit (Promega). All TCER® variants showed potent killing of PRAME-004-loaded T2 cells with subpicomolar $EC_{50}$ values at a peptide loading concentration of 10 nM (FIG. 10, Table 17). $EC_{50}$ values increased for decreasing PRAME-004 loading levels. However, even at a very low PRAME-004 loading concentration of 10 pM, killing was induced by all TCER® variants, except for TPP-214.

TABLE 15

$K_D$ values for binding to HLA-A*02/PRAME-004 and $K_D$ windows of four selected off-target peptides measured via bio-layer interferometry for TCER ® Slot III variants.

| TCER ® variant | Recruiter | Va, Vb (SEQ ID NO) | PRAME-004 $K_D$ (M) | $K_D$ FARSA-001/ $K_D$ PRAME-004 | $K_D$ GIMAP8-001/ $K_D$ PRAME-004 | $K_D$ SMARCD1-001/ $K_D$ PRAME-004 | $K_D$ VIM-009/ $K_D$ PRAME-004 |
|---|---|---|---|---|---|---|---|
| TPP-230 | ID4 | 132, 135 | 3.05E−09 | — | 120[1] | 130[1] | — |
| TPP-871 | ID4 | 137, 135 | 2.89E−09 | — | — | — | — |
| TPP-222 | ID4 | 132, 134 | 1.56E−09 | 118 | 69 | 74 | 112[1] |
| TPP-872 | ID4 | 137, 134 | 1.60E−09 | 95 | 103 | 119[1] | 2153 |
| TPP-214 | BMA031(V36) | 132, 134 | 2.43E−09 | 216 | 59 | 66 | 389 |
| TPP-876 | BMA031(V36)A02 | 137, 134 | 2.43E−09 | 86 | 80 | 267 | 160[1] |
| TPP-666 | BMA031(V36)A02 | 132, 136 | 3.37E−09 | 507 | 142 | 121 | 171 |
| TPP-879 | BMA031(V36)A02 | 132, 135 | 4.55E−09 | — | — | — | — |
| TPP-891 | BMA031(V36)D01 | 137, 134 | 2.34E−09 | 76 | 85 | 254 | 146[1] |
| TPP-669 | BMA031(V36)D01 | 132, 136 | 3.65E−09 | 83[1] | 50[1] | 84 | 165 |
| TPP-894 | BMA031(V36)D01 | 132, 135 | 5.18E−09 | — | — | — | — |

[1]$K_D$ windows are expected to be higher than the values given in the table (calculated Rmax values for these interactions are too low due to overall low binding signals).

TABLE 16

$K_D$ values for binding to HLA-A*02/PRAME-004 and $K_D$ windows of Ala-substituted peptide variants for binding motif determination measured via bio-layer interferometry for TCER ® Slot III variants. For position 5, a threshold of 100 is given for the $K_D$ window. Recognition of this position is at least 100-fold.

| TCER ® variant | Recruiter | Va, Vb (SEQ ID NO) | PRAME-004 $K_{D, motif}$(M) | Binding motif | $K_D$ Ala/target | | | | | | |
|---|---|---|---|---|---|---|---|---|---|---|---|
| | | | | | A1 | A3 | A4 | A5 | A6 | A7 | A8 |
| TPP-230 | ID4 | 132, 135 | 3.03E−09 | -x3-5678x | 1.2 | 12.2 | 1.7 | 100.0 | 3.9 | 25.5 | 3.0 |
| TPP-871 | ID4 | 137, 135 | 2.47E−09 | 1x345678x | 2.5 | 39.3 | 4.7 | 100.0 | 16.5 | 89.9 | 8.3 |
| TPP-222 | ID4 | 132, 134 | 1.50E−09 | -x3-5-78x | 1.1 | 2.3 | 0.9 | 100.0 | 1.8 | 4.3 | 1.8 |
| TPP-872 | ID4 | 137, 134 | 1.48E−09 | -x3-5678x | 1.1 | 7.6 | 1.1 | 100.0 | 3.0 | 17.5 | 2.7 |
| TPP-214 | BMA031(V36) | 132, 134 | 3.17E−09 | -x3-5-78x | 0.9 | 2.1 | 0.8 | 100.0 | 1.6 | 4.6 | 1.7 |
| TPP-876 | BMA031(V36)A02 | 137, 134 | 2.87E−09 | -x3-567-x | 1.0 | 6.8 | 1.0 | 100.0 | 2.3 | 13.9 | 2.0 |
| TPP-666 | BMA031(V36)A02 | 132, 136 | 3.84E−09 | -x3-5678x | 1.1 | 7.9 | 1.2 | 100.0 | 2.6 | 9.7 | 2.1 |
| TPP-879 | BMA031V36)A02 | 132, 135 | 6.15E−09 | -x3-5678x | 1.1 | 12.5 | 1.6 | 100.0 | 3.5 | 27.5 | 2.6 |
| TPP-891 | BMA031(V36)D01 | 137, 134 | 2.80E−09 | -x:3-5678x | 1.0 | 7.2 | 1.1 | 100.0 | 2.6 | 14.7 | 2.3 |
| TPP-669 | BMA031(V36)D01 | 132, 136 | 3.28E−09 | -x3-5678x | 1.1 | 9.1 | 1.2 | 100.0 | 2.5 | 11.0 | 2.4 |
| TPP-894 | BMA031(V36)D01 | 132, 135 | 6.04E−09 | -x3-5678x | 1.2 | 14.9 | 1.9 | 100.0 | 3.8 | 26.4 | 2.8 |
| TPP-1109 | UCHT1-V17 | (CDR6) | 2.47E−09 | -x-5678x | 0.9 | 0.8 | 1.2 | 49.0 | 7.9 | 55.7 | 4.1 |

TABLE 17

In vitro cytotoxicity of TCER ® Slot III variants on PRAME-004-loaded T2 cells. T2 cells were co-
cultured with human PBMCs at an E:T ratio of 5:1 for 48 h. PRAME-004 loading concentrations are indicated.
Ec$_{50}$ values and cytotoxicity levels in the plateau (Top) were calculated using non-linear 4-point curve fitting.

| TCER ® variant | Recruiter | Va, Vb (SEQ ID NO) | 10 nM PRAME-004 EC$_{50}$ [pM] | Top | 1 nM PRAME-004 EC$_{50}$ [pM] | Top | 100 pM PRAME-004 EC$_{50}$ [pM] | Top | 10 pM PRAME-004 EC$_{50}$ [pM] | Top |
|---|---|---|---|---|---|---|---|---|---|---|
| TPP-230 | ID4 | 132, 135 | 0.09 | 109 | 0.9 | 139 | 23.2[1] | 179 | 145 | 80 |
| TPP-871 | ID4 | 137, 135 | 0.13 | 109 | 1.6 | 143 | 76.5[1] | 90 | 361 | 76 |
| TPP-222 | ID4 | 132, 134 | complete killing | 109 | complete killing | 78 | 2.8[1] | 127 | 58 | 90 |
| TPP-872 | ID4 | 137, 134 | complete killing | 109 | complete killing | 151 | 4.3[1] | 84 | 49 | 74 |
| TPP-876 | BMA031(V36)A02 | 137, 134 | 0.16 | 111 | 2.0 | 113 | 24.4 | 100 | 539 | 40 |
| TPP-666 | BMA031(V36)A02 | 132, 136 | 0.15 | 113 | 2.4 | 113 | 39.8 | 100 | 182 | 35 |
| TPP-879 | BMA031(V36)A02 | 132, 135 | 0.54 | 106 | 6.2 | 109 | 94.4 | 117 | 1070 | 39 |
| TPP-214 | BMA031(V36) | 132, 134 | 0.22 | 108 | 5.0 | 109 | 92.8 | 102 | no killing | 20 |
| TPP-891 | BMA031(V36)D01 | 137, 134 | 0.19 | 120 | 2.2 | 112 | 54.0 | 125 | 611 | 45 |
| TPP-669 | BMA031(V36)D01 | 132, 136 | 0.22 | 124 | 3.2 | 108 | 84.0 | 126 | 246 | 31 |
| TPP-894 | BMA031(V36)D01 | 132, 135 | 0.87 | 108 | 9.9 | 115 | 226.0 | 129 | 1084 | 44 |
| TPP-214 | BMA031(V36) | 132, 134 | 0.26 | 121 | 5.4 | 111 | 105.4 | 99 | no killing | 23 |

[1]High variability within replicates do not allow for reliable EC$_{50}$ calculation.

TABLE 18

Bispecific molecules

| ID | α-chain SEQ ID NO | β-chain SEQ ID NO |
|---|---|---|
| TPP-70 | 93 | 94 |
| TPP-71 | 93 | 95 |
| TPP-72 | 93 | 96 |
| TPP-73 | 93 | 97 |
| TPP-74 | 93 | 98 |
| TPP-93 | 100 | 101 |
| TPP-79 | 103 | 102 |
| TPP-105 | 105 | 104 |
| TPP-106 | 106 | 107 |
| TPP-108 | 106 | 101 |
| TPP-109 | 111 | 110 |
| TPP-110 | 111 | 102 |
| TPP-111 | 103 | 110 |
| TPP-112 | 100 | 107 |
| TPP-113 | 100 | 119 |
| TPP-114 | 100 | 121 |
| TPP-115 | 122 | 121 |
| TPP-116 | 106 | 121 |
| TPP-117 | 126 | 121 |
| TPP-118 | 128 | 121 |
| TPP-119 | 100 | 131 |
| TPP-120 | 100 | 133 |
| TPP-121 | 122 | 133 |
| TPP-122 | 106 | 133 |
| TPP-123 | 126 | 133 |
| TPP-124 | 128 | 133 |
| TPP-125 | 100 | 143 |
| TPP-126 | 122 | 143 |
| TPP-127 | 106 | 143 |
| TPP-128 | 126 | 143 |
| TPP-129 | 128 | 143 |
| TPP-207 | 103 | 152 |
| TPP-208 | 155 | 152 |
| TPP-209 | 157 | 152 |
| TPP-210 | 159 | 152 |
| TPP-211 | 103 | 160 |
| TPP-212 | 155 | 162 |
| TPP-213 | 157 | 162 |
| TPP-214 | 167 | 160 |
| TPP-215 | 169 | 168 |
| TPP-216 | 171 | 168 |
| TPP-217 | 173 | 168 |
| TPP-218 | 167 | 168 |
| TPP-219 | 177 | 176 |
| TPP-220 | 179 | 176 |

TABLE 18-continued

Bispecific molecules

| ID | α-chain SEQ ID NO | β-chain SEQ ID NO |
|---|---|---|
| TPP-221 | 181 | 176 |
| TPP-222 | 183 | 176 |
| TPP-226 | 159 | 184 |
| TPP-227 | 105 | 186 |
| TPP-228 | 189 | 186 |
| TPP-229 | 191 | 186 |
| TPP-230 | 193 | 186 |
| TPP-235 | 195 | 160 |
| TPP-236 | 197 | 160 |
| TPP-237 | 199 | 160 |
| TPP-238 | 201 | 160 |
| TPP-239 | 203 | 160 |
| TPP-240 | 205 | 160 |
| TPP-241 | 207 | 160 |
| TPP-242 | 209 | 160 |
| TPP-243 | 211 | 160 |
| TPP-244 | 213 | 160 |
| TPP-245 | 215 | 160 |
| TPP-246 | 217 | 216 |
| TPP-247 | 217 | 218 |
| TPP-248 | 217 | 220 |
| TPP-249 | 217 | 222 |
| TPP-250 | 217 | 224 |
| TPP-252 | 217 | 228 |
| TPP-253 | 217 | 230 |
| TPP-254 | 217 | 232 |
| TPP-255 | 217 | 234 |
| TPP-256 | 217 | 236 |
| TPP-257 | 217 | 238 |
| TPP-258 | 217 | 240 |
| TPP-259 | 217 | 242 |
| TPP-260 | 217 | 244 |
| TPP-261 | 217 | 246 |
| TPP-262 | 217 | 248 |
| TPP-263 | 217 | 250 |
| TPP-264 | 217 | 252 |
| TPP-265 | 217 | 254 |
| TPP-266 | 217 | 256 |
| TPP-267 | 217 | 258 |
| TPP-268 | 217 | 260 |
| TPP-269 | 217 | 262 |
| TPP-270 | 217 | 264 |
| TPP-271 | 217 | 266 |
| TPP-272 | 155 | 268 |
| TPP-273 | 189 | 270 |

TABLE 18-continued

Bispecific molecules

| ID | α-chain SEQ ID NO | β-chain SEQ ID NO |
|---|---|---|
| TPP-274 | 189 | 272 |
| TPP-275 | 189 | 274 |
| TPP-276 | 189 | 276 |
| TPP-277 | 189 | 278 |
| TPP-279 | 189 | 282 |
| TPP-666 | 285 | 284 |
| TPP-669 | 291 | 284 |
| TPP-871 | 295 | 186 |
| TPP-872 | 295 | 296 |
| TPP-876 | 299 | 162 |
| TPP-879 | 285 | 300 |
| TPP-891 | 303 | 162 |
| TPP-892 | 303 | 284 |
| TPP-894 | 291 | 300 |
| TPP-1292 | 151 | 284 |
| TPP-1293 | 156 | 162 |
| TPP-1294 | 158 | 284 |
| TPP-1295 | 158 | 300 |
| TPP-1296 | 303 | 161 |
| TPP-1297 | 303 | 163 |
| TPP-1298 | 291 | 164 |
| TPP-1300 | 291 | 165 |
| TPP-1301 | 166 | 300 |
| TPP-1302 | 291 | 170 |
| TPP-1303 | 291 | 172 |
| TPP-1304 | 291 | 174 |
| TPP-1305 | 166 | 170 |
| TPP-1306 | 166 | 172 |
| TPP-1307 | 166 | 174 |
| TPP-1308 | 291 | 182 |
| TPP-1309 | 291 | 185 |
| TPP-1332 | 175 | 186 |
| TPP-1333 | 178 | 186 |
| TPP-1334 | 180 | 186 |

In table 18, except for TPP-70, TPP-71, TPP-72, TPP-73 and TPP74, the term "α-chain" refers to a polypeptide chain comprising a $V_\alpha$, i.e. a variable domain derived from a TCR α-chain. The term "β-chain" refers to a polypeptide chain comprising a $V_\beta$, i.e. a variable domain derived from a TCR β-chain. For TPP-70, TPP-71, TPP-72, TPP-73 and TPP74, the "α-chain" does not comprise any TCR derived variable domains, but the "β-chain" comprises two TCR-derived variable domains, one derived from a TCR α-chain and one derived from a TCR β-chain.

Example 3.6: Safety Assessment for Selected TCER® Slot III Candidates

Figure 11:
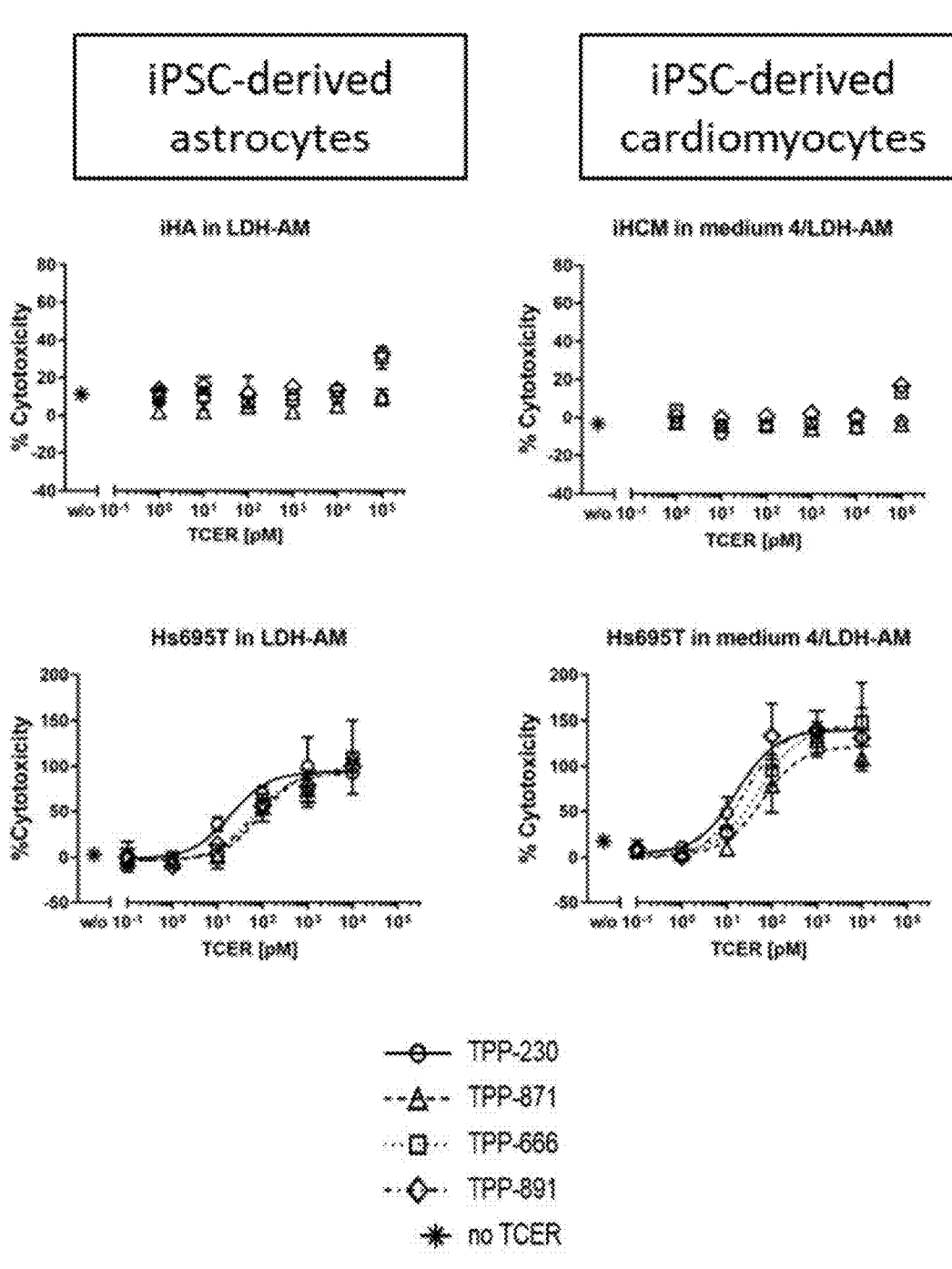
FIG. 11: Normal tissue cell safety analysis for selected TCER® Slot III variants. TCER®-mediated cytotoxicity against 5 different normal tissue cell types expressing HLA-A*02 was assessed in comparison to cytotoxicity directed against PRAME-004-positive Hs695T tumor cells. PBMCs from a healthy NIA-A*02+ donor were co-cultured at a ratio 10:1 with the normal tissue cells or Hs695T tumor cells (in triplicates) in a 1:1 mixture of the respective normal tissue cell medium (4, 10a or 13a) and T cell medium (LDH-AM) or in T cell medium alone. After 48 hours, lysis of normal tissue cells and Hs695T cells was assessed by measuring LDH release (LDH-Glo™ Kit, Promega).
Figure 11:
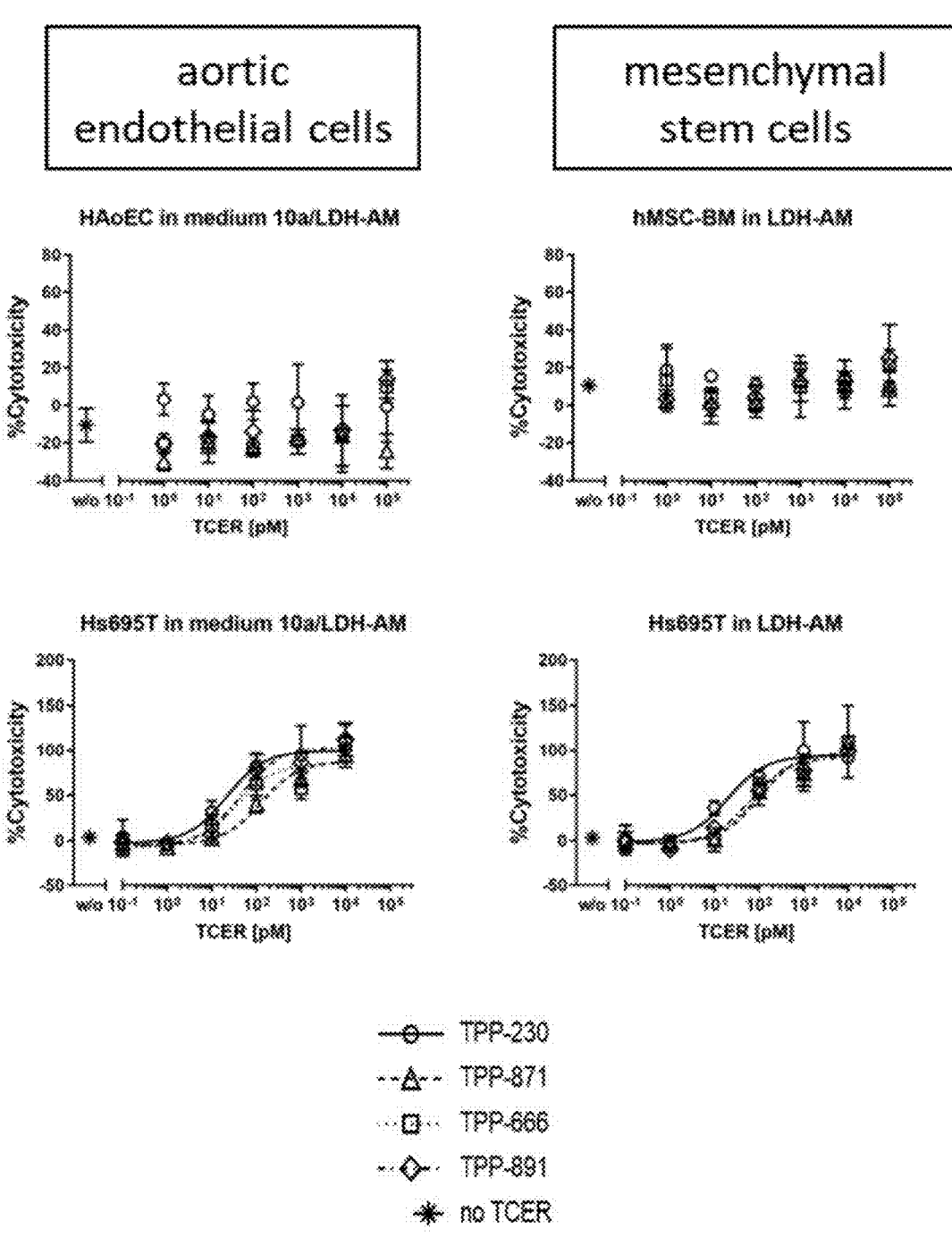
Figure 11:
Figure 11:
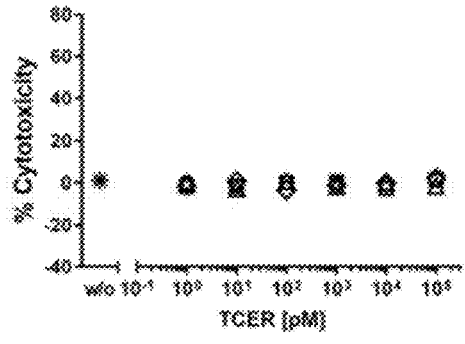
Figure 11:
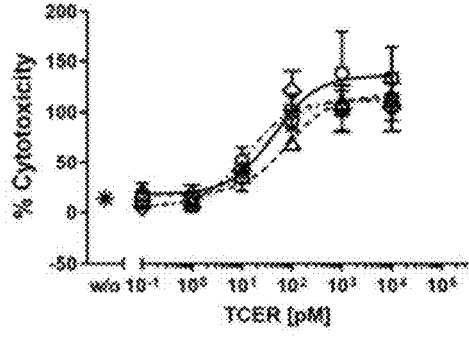

The safety profile of the TCER® molecules TPP-230, TPP-666, TPP-871 and TPP-891 (Tables 14-18) was assessed in killing experiments with astrocytes and cardiomyocytes (derived from induced pluripotent stem cells) as well as aortic endothelial cells, mesenchymal stem cells and tracheal smooth muscle cells. FIG. 11 shows the results of co-cultures of above normal cell types (all expressing HLA-A*02) with PBMC effector cells from a healthy HLA-A*02+ donor at a ratio of 1:10 (target cells:effector cells) in presence of increasing TCER® concentrations. The cells were co-cultured in a 1:1 mixture of the respective normal tissue cell medium and T cell medium or in T cell medium alone (LDH-AM). After 48 h of co-culture, supernatants were harvested and TCER® induced normal tissue cell lysis was assessed by measuring LDH release with the LDH-Glow Kit (Promega). To determine a safety window, the TCER® molecules were co-incubated in an identical setup with the PRAME-004-positive tumor cell line Hs695T in the respective 1:1 mixture of normal tissue cell medium and T cell medium followed by the assessment of LDH release.

As shown in FIG. 11, no cytotoxicity against normal tissue cells was observed with TPP-230 and TPP-871 even at the highest TCER® concentration of 100 nM. For TPP-666 and TPP-891 some normal tissue cell lysis was observed at 100 nM TCER® concentration but no lysis was detected at 10 nM. When compared to Hs695T tumor cells that showed pronounced lysis at 100 pM for all tested TCER® molecules and for some molecules even lysis at 10 pM concentration, the normal tissue cell lysis at 100 nM concentration indicates a safety window of 1,000-fold (TPP-666 and TPP-891) or more (TPP-230 and TPP-871).

Example 3.7: Slot IV

Further TCER® were constructed utilizing $V_H$ and $V_L$ domains derived from BMA031(V36) or modified variants (A02 and D01) thereof, or 104 as well as Valpha and Vbeta as described above (example 3.1). DNA constructs coding for the respective molecules were generated as outlined above. Resulting plasmids were used for transfection of CHO-S cells by electroporation (MaxCyte) for transient expression and production of TCER® variants (Table 20 and Table 18). Purification, formulation and initial characterization of molecules was performed as outlined above in example 3.3.

TABLE 20

Summary of productivity and stress stability data obtained for TCER ® molecules of slot IV.

| TCER ® variant | α-chain, β-chain (SEQ ID NO) | Recruiter | Final product yield (mg/L) | Monomer (%) | Monomer (%) after 14 days at 40° C. |
|---|---|---|---|---|---|
| TPP-1292 | 151, 284 | BMA031(V36)A02__H90Y | 42.9 | 97.53 | 93.46 |
| TPP-1294 | 158, 284 | BMA031(V36)D01__H90Y | 39.8 | 97.78 | 90.61 |
| TPP-1295 | 158, 300 | BMA031(V36)D01__H90Y | 56.5 | 94.89 | 91.49 |
| TPP-1296 | 303, 161 | BMA031(V36)D01 | 50.7 | 79.21 | 75.17 |
| TPP-1297 | 303, 163 | BMA031(V36)D01 | 41.3 | 94.12 | 86.77 |
| TPP-1298 | 291, 164 | BMA031(V36)D01 | 68.1 | 94.41 | 89.7 |
| TPP-1300 | 291, 165 | BMA031(V36)D01 | 43.9 | 96.81 | 87.5 |
| TPP-1301 | 166, 300 | BMA031(V36)D01 | 73.7 | 94.57 | 90.89 |
| TPP-1302 | 291, 170 | BMA031(V36)D01 | 67.3 | 83.48 | 79.58 |
| TPP-1303 | 291, 172 | BMA031(V36)D01 | 48.5 | 74.95 | 71.03 |
| TPP-1304 | 291, 174 | BMA031(V36)D01 | 55.0 | 95.13 | 88.87 |
| TPP-1305 | 166, 170 | BMA031(V36)D01 | 51.6 | 81.55 | 77.75 |
| TPP-1306 | 166, 172 | BMA031(V36)D01 | 71.7 | 86.37 | 81.18 |
| TPP-1307 | 166, 174 | BMA031(V36)D01 | 60.7 | 95.93 | 88.16 |
| TPP-1308 | 291, 182 | BMA031(V36)D01 | 61.9 | 92.28 | 87.98 |
| TPP-1309 | 291, 185 | BMA031(V36)D01 | 74.8 | 98.98 | 91.11 |

TABLE 20-continued

Summary of productivity and stress stability data obtained for TCER ® molecules of slot IV.

| TCER ® variant | α-chain, β-chain (SEQ ID NO) | Recruiter | Final product yield (mg/L) | Monomer (%) | Monomer (%) after 14 days at 40° C. |
|---|---|---|---|---|---|
| TPP-1332 | 175, 186 | ID4 variant | 0 | n/a | n/a |
| TPP-1333 | 178, 186 | ID4 variant | 61.1 | 98.52 | 95.51 |
| TPP-1334 | 180, 186 | ID4 variant | 61.4 | 98.42 | 95.94 |

In table 20, the term "α-chain" refers to a polypeptide chain comprising a $V_\alpha$, i.e. a variable domain derived from a TCR α-chain. The term "β-chain" refers to a polypeptide chain comprising a $V_\beta$, i.e. a variable domain derived from a TCR β-chain.

Potency of TCER® molecules with respect to killing of HLA-A*02-positive tumor cell lines presenting different levels of PRAME-004 target peptide on their cell surface, was assessed in LDH-release assays. In addition, an HLA-A*02-positive but PRAME-004-negative tumor cell line (e.g. T98G) was assessed to characterize unspecific or off-target activity of the TCER® variants. Tumor cell lines were co-incubated with PBMC effectors derived from healthy HLA-A*02-positive donors at a ratio of 1:10 and in the presence of increasing TCER® concentrations. TCER®-induced cytotoxicity was quantified after 48 hours of co-culture by measurement of released LDH. $EC_{50}$ values of dose-response curves were calculated utilizing non-linear 4-point curve fitting. $EC_{50}$ values for a PRAME-004-positive tumor cell lines U2OS and a PRAME-004-negative tumor cell line (T98G) were determined In different experiments with different PBMC donors and are summarized in table 21.

using Octet Data Analysis HT Software. Reference sensor subtraction was performed to subtract potential dissociation of peptide-HLA loaded onto the biosensor (via a biosensor loaded with peptide-HLA measured in buffer). Data traces were aligned to baseline (average of the last 5 s), inter-step correction was done to the dissociation step, Savitzky-Golay filtering was applied and curves were fitted globally using a 1:1 binding model (with Rmax unlinked by sensor). Strong binding affinities were found with $K_D$ values ranging from 2 nM to 15 nM (Table 22). Furthermore, binding affinities were determined for two previously identified potential off-target peptides and $K_D$ windows were calculated compared to binding of the target peptide-HLA. Measurements were performed on an Octet RED384 or HTX system at 30° C. Assays were run at a sensor offset of 3 mm and an acquisition rate of 5 Hz on HIS 1K biosensors in 16-channel mode using PBS, 0.05% Tween-20, 0.1% BSA as assay buffer. The following assay step sequence was repeated to measure all binding affinities: regeneration (5 s, 10 mM glycine pH 1.5)/neutralization (5 s, assay buffer; one regeneration cycle consists of four repeats of regeneration/neutralization), baseline (60 s, assay buffer), loading (120 s, 10 µg/mi peptide-HLA), baseline (120 s, assay buffer), asso-

TABLE 24

Summary of LDH-release assay data obtained for TCER ® molecules of slot IV.

| TCER ® variant | EC50 [pM] for HBC-1005 vs U2OS | EC50 [pM] for HBC-1005 vs T98G | EC50 [pM] for HBC-848 vs U2OS | EC50 [pM] for HBC-848 vs T98G |
|---|---|---|---|---|
| TPP-1292 | 66 | 22,659 | 547 | 77,267 |
| TPP-1294 | 99 | 69,150 | 431 | >100,000 |
| TPP-1295 | 150 | >100,000 | 663 | >100,000 |
| TPP-1297 | 2,526 | >100,000 | 4,096 | >100,000 |
| TPP-1298 | 48 | 37,953 | 249 | >100,000 |
| TPP-1300 | 186 | >100,000 | 811 | >100,000 |
| TPP-1301 | 240 | >100,000 | 979 | >100,000 |
| TPP-1304 | 7125 | >100,000 | 13,686 | >100,000 |
| TPP-1307 | 8,056 | >100,000 | >100,000 | >100,000 |
| TPP-1333 | 226 | >100,000 | 719 | >100,000 |
| TPP-1334 | 217 | >100,000 | 829 | >100,000 |

TCER® Slot IV variants TPP-1292, -1294 to -1298, -1300 to -1309, -1333, -1334 were analyzed for their binding affinity to the target peptide-HLA complex (HLA-A*02/PRAME-004) via bio-layer interferometry. Measurements were performed on an Octet HTX system at 30° C. Assays were run at a sensor offset of 3 mm and an acquisition rate of 5 Hz on HIS1K biosensors in 16-channel mode using PBS, 0.05% Tween-20, 0.1% BSA as assay buffer. The following assay step sequence was repeated to measure all binding affinities: regeneration (5 s, 10 mM glycine pH 1.5)/neutralization (5 s, assay buffer; one regeneration cycle consists of four repeats of regeneration/neutralization), baseline (60 s, assay buffer), loading (120 s, 10 µg/mi peptide-HLA), baseline (120 s, assay buffer), association (300 s, twofold serial dilution of TCER's ranging from 100 nM to 1.56 nM or 50 nM to 0.78 nM, assay buffer as reference), dissociation (300 s, assay buffer). Data evaluation was done ciation (300 s, twofold serial dilution of TCER® ranging from 500 nM to 7.81 nM, assay buffer as reference), dissociation (300 s, assay buffer). Data evaluation was done using Octet Data Analysis HT Software. Reference sensor subtraction was performed to subtract potential dissociation of peptide-HLA loaded onto the biosensor (via a biosensor loaded with the respective peptide-HLA measured in buffer). Data traces were aligned to baseline (average of the last 5 s), inter-step correction was done to the dissociation step, Savitzky-Golay filtering was applied and curves were fitted globally using a 1:1 binding model (with Rmax unlinked by sensor). Overall, considerable weaker binding to the potential off-target peptides compared to target peptide was found for all variants showing windows of at least 10-fold to even no binding at all. Respective interactions are indicated in Table 22. To further analyze specificity of the variants TPP-1294, -1295, -1298, -1333, -1334, binding motifs were determined by measuring the affinities for the target peptide-HLA complex as well as for the alanine-substituted variants for positions 1, 3, 4, 5, 6, 7, 8. Measurements were performed on an Octet HTX system at 30° C. Assays were run at a sensor offset of 3 mm and an acquisition rate of 5 Hz on HIS1K biosensors in 16- or 8-channel mode using PBS, 0.05% Tween-20, 0.1% BSA as assay buffer. The following assay step sequence was repeated to measure all binding affinities: regeneration (5 s, 10 mM glycine pH 1.5)/neutralization (5 s, assay buffer; one regeneration cycle consists of four repeats of regeneration/neutralization), baseline (60 s, assay buffer), loading (120 s, 10 µg/ml peptide-HLA), baseline (120 s, assay buffer), association (150 s, twofold serial dilution of TCER® ranging from 400 nM to 6.25 nM, assay buffer as reference), dissociation (300 s, assay buffer). Data evaluation was done using Octet Data Analysis HT Software. Reference sensor subtraction was performed to subtract potential dissociation of peptide-HLA loaded onto the biosensor (via a biosensor loaded with the respective peptide-HLA measured in buffer). Data traces were aligned to baseline (average of the last 5 s), inter-step correction was done to the dissociation step, Savitzky-Golay filtering was applied and curves were fitted globally using a 1:1 binding model (with Rmax unlinked by sensor). A position was considered part of the binding motif for an at least 2-fold reduction in affinity or binding signal (measured for the highest concentration analyzed). All tested TCER® variants showed broad binding motifs recognizing at least five and up to all analyzed peptide positions (Table 23).

TABLE 22

$K_D$ values for binding to HLA-A*02/PRAME-004 and $K_D$ windows of two selected off-target peptides measured via bio-layer interferometry for TCER ® Slot IV variants.

| TCER ® variant | PRAME-004 $K_D$ (M) | $K_D$ IFIT-001/ $K_D$ PRAME-004 | $K_D$ MCMB-002/ $K_D$ PRAME-004 |
|---|---|---|---|
| TPP-1292 | 2.55E−09 | 29.5 | 18.6 |
| TPP-1294 | 3.06E−09 | 30.7 | 20.4 |
| TPP-1295 | 3.39E−09 | 45.2 | 28.6 |
| TPP-1298 | 2.47E−09 | 24.1 | 17.2 |
| TPP-1300 | 3.90E−09 | 20.6 | 20.7 |
| TPP-1301 | 5.77E−09 | 33.6 | 16.8 |
| TPP-1302 | 3.92E−09 | 26.4 | 16.1 |
| TPP-1303 | 4.58E−09 | 23.0 | 17.6 |
| TPP-1304 | 2.74E−08 | >100 | >100 |
| TPP-1305 | 5.19E−09 | 23.8 | 13.7 |
| TPP-1306 | 5.20E−09 | 47.2 | 23.3 |
| TPP-1307 | 3.97E−08 | >100 | >100 |
| TPP-1308 | 1.54E−08 | 83.4 | 76.7 |
| TPP-1309 | 1.33E−08 | 38.8 | 9.9 |
| TPP-1333 | 2.94E−09 | 27.3 | 16.0 |
| TPP-1334 | 2.48E−09 | 26.7 | 18.0 |

TABLE 23

$K_D$ values for binding to HLA-A*02/PRAME-004 and $K_D$ windows of Ala-substituted peptide variants for binding motif determination measured via bio-layer interferometry for TCER ® Slot IV variants. For position 5, a threshold of 100 is given for the $K_D$ window. Recognition of this position is at least 100-fold.

| TCER ® variant | PRAME-004 $K_{D, motif}$ (M) | Binding motif | A1 | A3 | A4 | A5 | A6 | A7 | A8 |
|---|---|---|---|---|---|---|---|---|---|
| | | | | | | $K_D$ Ala/target | | | |
| TPP-1294 | 4.35E−09 | -x3-5678x | 1.6 | 10.6 | 2.0 | 92.4 | 3.6 | 13.8 | 3.3 |
| TPP-1295 | 3.87E−09 | 1x345678x | 2.2 | 21.8 | 2.8 | 20.7 | 5.2 | 35.3 | 5.0 |
| TPP-1298 | 2.87E−09 | -x3-5678x | 1.4 | 10.3 | 1.6 | 100.0 | 2.9 | 9.6 | 2.8 |
| TPP-1333 | 2.60E−09 | -x3-5678x | 1.4 | 12.8 | 2.0 | 100.0 | 3.9 | 21.0 | 3.7 |
| TPP-1334 | 3.09E−09 | -x3-5678x | 1.1 | 9.2 | 1.6 | 100.0 | 3.1 | 15.9 | 2.6 |

Example 3.8: Safety Assessment for Selected TCER® Slot IV Candidates

Figure 12:
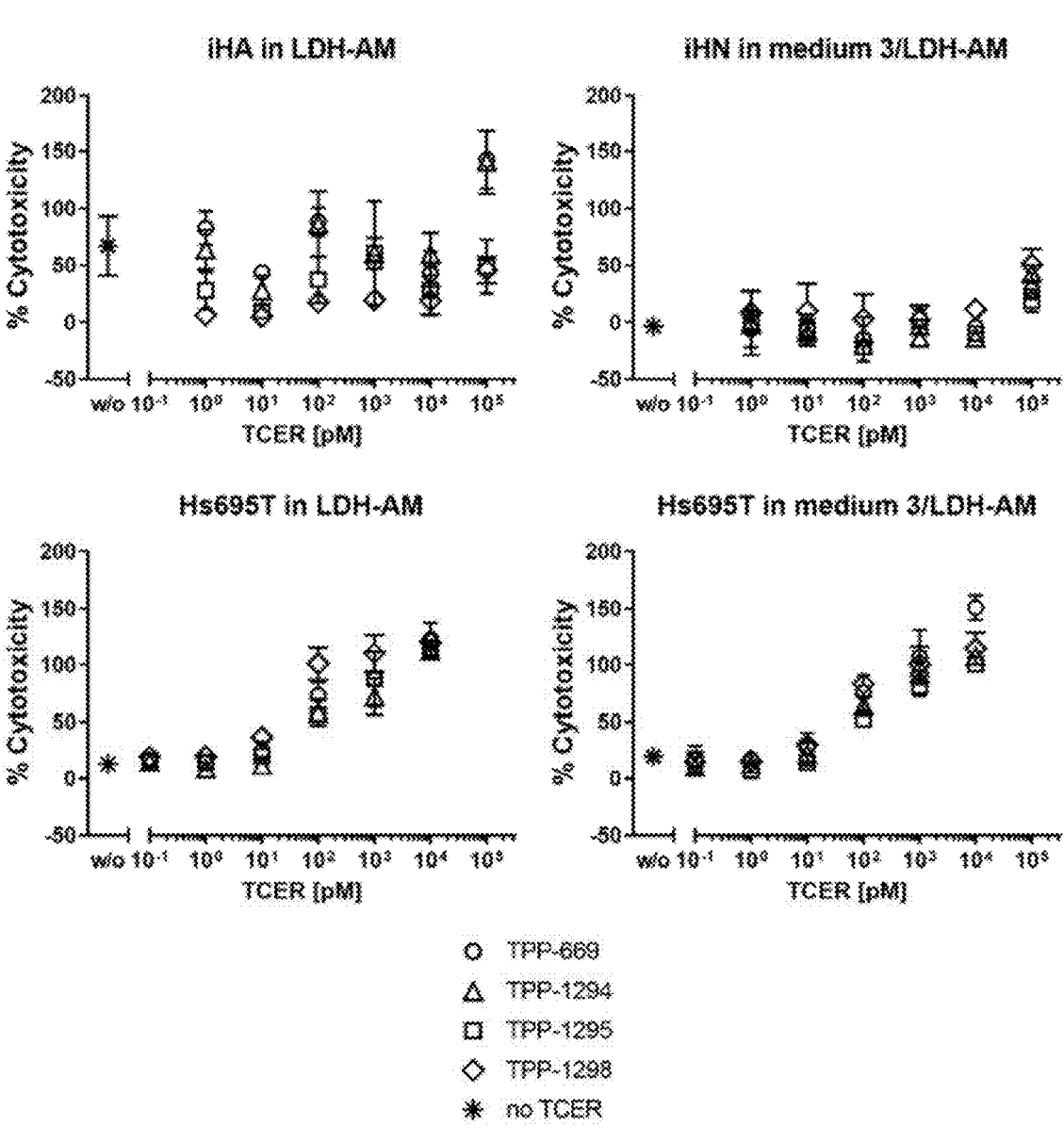
FIG. 12: Normal tissue cell safety analysis for selected TCER® Slot IV variants. TCER®-mediated cytotoxicity against 10 different normal tissue cell types expressing HLA-A*02 was assessed in comparison to cytotoxicity directed against PRAME-004-positive Hs695T tumor cells.
Figure 12:
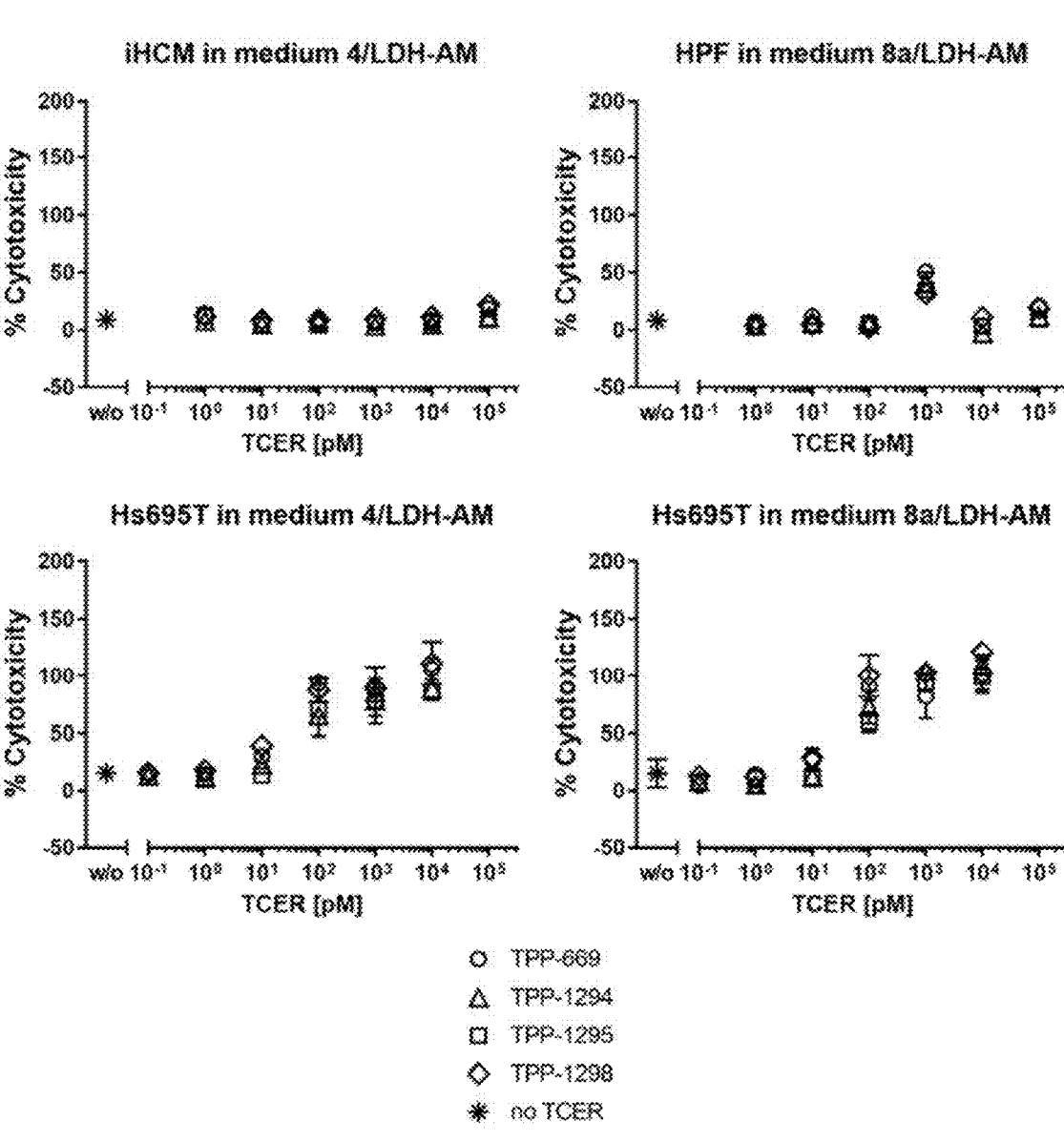
Figure 12:
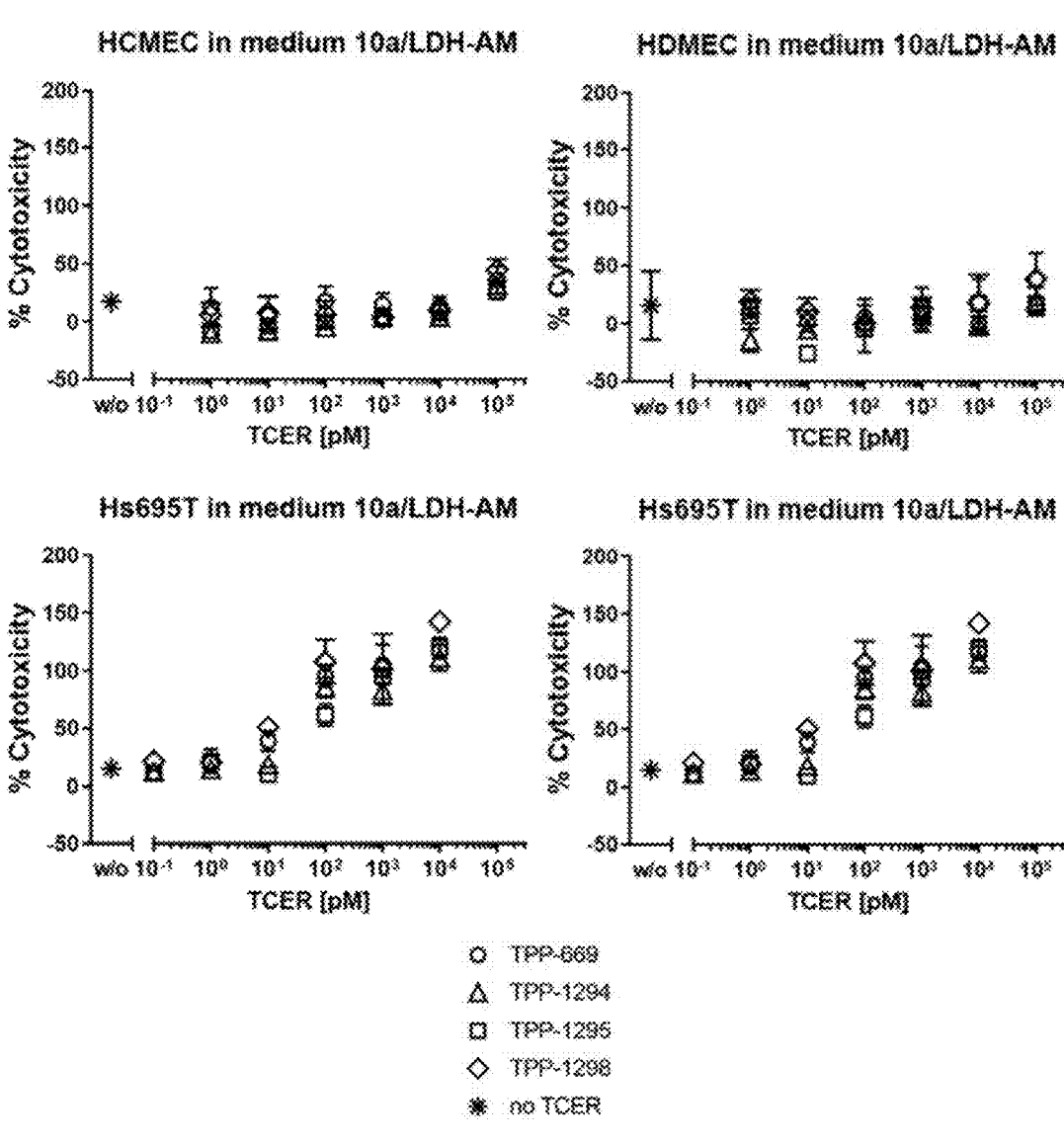
Figure 12:
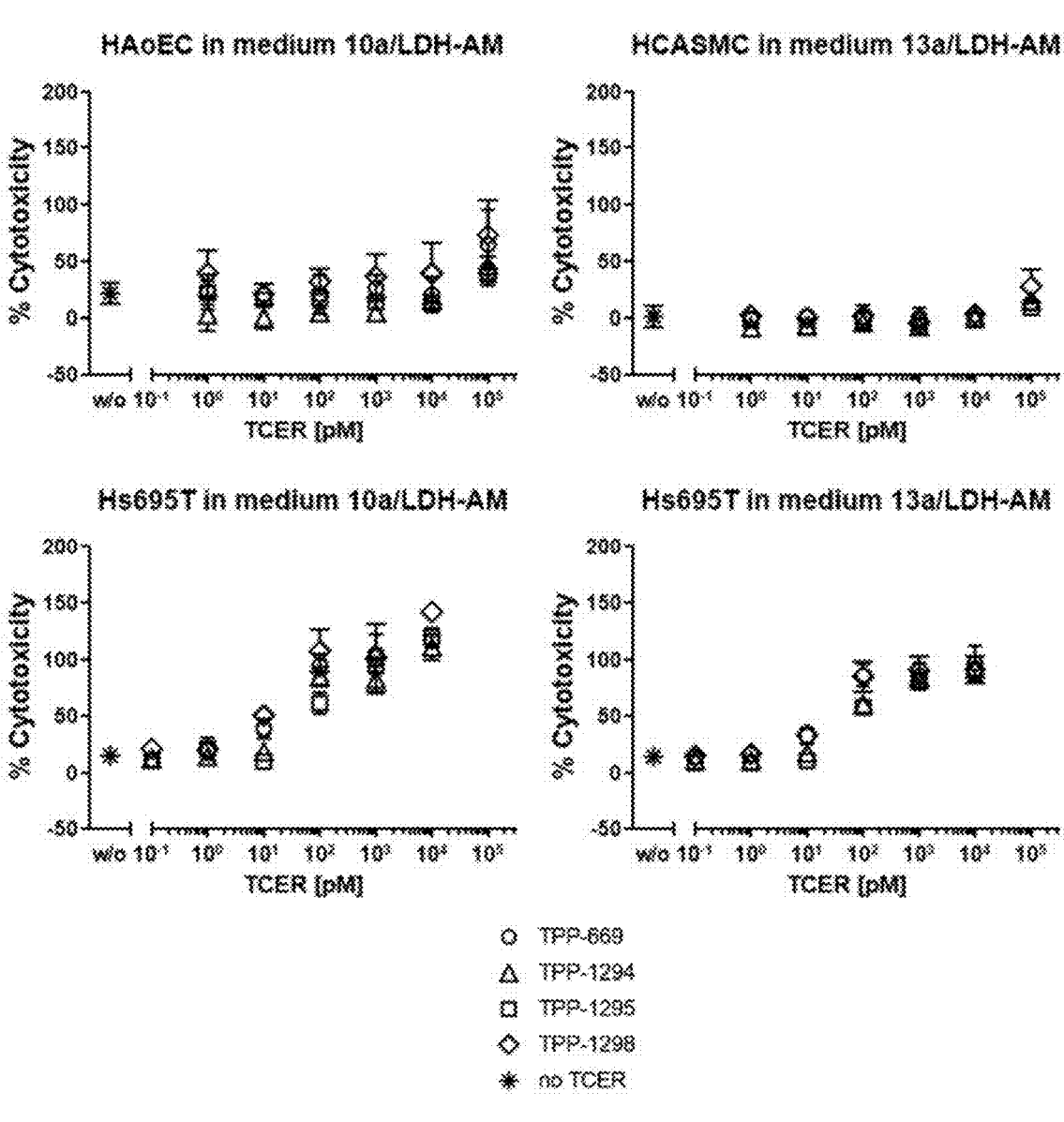
Figure 12:
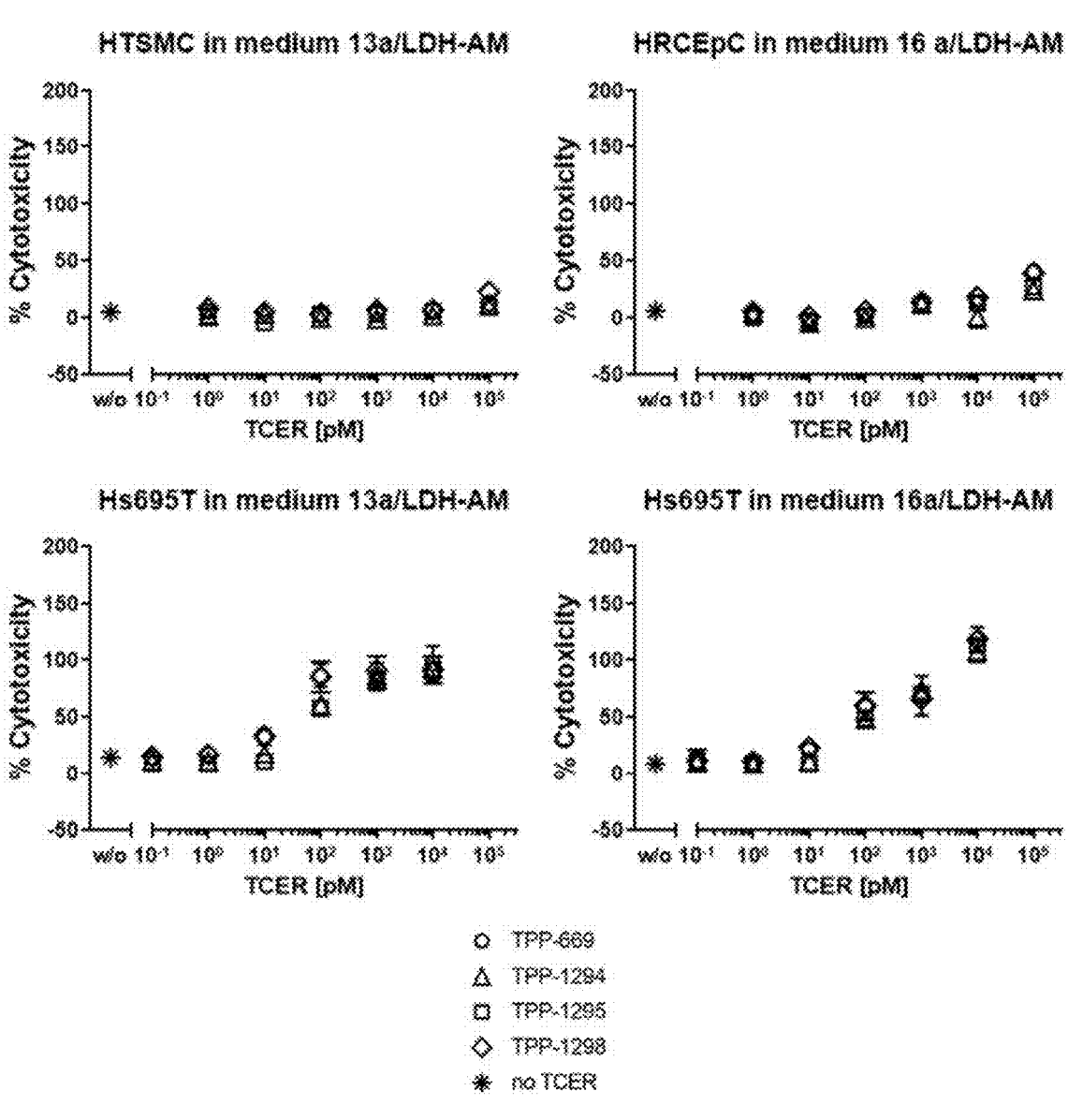

The safety profile of the TCER® molecules TPP-1294, TPP-1295, TPP-1298, TPP-1333 and TPP-1334 (Tables 18 and 20-23) was assessed in killing experiments with astrocytes, GABAergic neurons and cardiomyocytes (derived from induced pluripotent stem cells; iHA, iHN and iHCM, respectively) as well as pulmonary fibroblasts (HPF), cardiac microvascular endothelial cells (HCMEC), dermal microvascular endothelial cells (HDMEC), aortic endothelial cells (HAoEC), coronary artery smooth muscle cells (HCASMC), renal cortical epithelial cells (HRCEpC) and tracheal smooth muscle cells (HTSMC). Furthermore, a bridging molecule TPP-891 was tested together with other molecules TPP-214 and TPP-669 from earlier slots. FIGS. 12 and 13 show the results of co-cultures of above normal cell types (all expressing HLA-A*02) with PBMC effector cells from a healthy HLA-A*02+ donor at a ratio of 1:10 (target cells:effector cells) in presence of increasing TCER® concentrations. The cells were co-cultured in a 1:1 mixture of the respective normal tissue cell medium and T cell medium or in T cell medium alone (LDH-AM). After 48 h of co-culture, supernatants were harvested and TCER®-induced normal tissue cell lysis was assessed by measuring LDH release with the LDH-Glo™ Kit (Promega). To determine a safety window, the TCER® molecules were co-incubated in an identical setup with the PRAME-004-positive tumor cell line Hs695T in the respective 1:1 mixture of normal tissue cell medium and T cell medium followed by the assessment of LDH release.

As shown in FIGS. 12 and 13, no cytotoxicity against normal tissue cells was observed for any of the tested molecules until a concentration of 10 nM TCER®. At a concentration of 100 nM only the bridging and reference molecules TPP-891, TPP-669 and TPP-214 show a somehow increased cytotoxicity level above background. The only exception is TPP-1294 in iPSC-derived astrocytes with elevated cytotoxicity exclusively at 100 nM. When compared to Hs695T tumor cells that showed pronounced lysis at 100 pM for all tested TCER® molecules and for some molecules even lysis at 10 pM concentration, the normal tissue cell lysis at 100 nM concentration indicates a safety window of 1,000-fold (TPP-1294) or more (TPP-1295, TPP-1298, TPP-1334 and TPP-1335).

Example 4: Detection of PRAME Peptide on Primary Tissues by Mass Spectrometry

For the identification and relative quantitation of HLA ligands by mass spectrometry, HLA molecules from shockfrozen tissue samples were purified and HLA-associated peptides were isolated. The isolated peptides were separated, and sequences were identified by online nano-electrospray-ionization (nanoESI) liquid chromatography-mass spectrometry (LC-MS) experiments. Since the peptides were directly identified as ligands of HLA molecules of primary tumors, these results provide direct evidence for the natural processing and presentation of the identified peptides on the primary cancer tissue. The acquired LC-MS data are subsequently processed and quantified using a proprietary label-free quantitation data analysis pipeline, combining algorithms for sequence identification, spectral clustering, ion counting, retention time alignment, charge state deconvolution and normalization. Resulting target detection frequencies are depicted herein below in Table 19.

TABLE 19

Peptide detection frequency in tumor samples.
The target detection frequency is indicated
as + (>0%), ++ (>10%), +++ (>30%), or ++++ (>50%).

| Entity | Target detection frequency |
| --- | --- |
| acute myeloid leukemia (AML) | + |
| breast cancer (BRCA) | ++ |
| cholanglocellular carcinoma (CCC) | + |
| chronic lymphocytic leukemia (CLL) | + |
| colorectal carcinoma (CRC) | + |
| gallbladder cancer (GBC) | ++ |
| glioblastoma (GBM) | + |
| hepatocellular carcinoma (HCC) | + |
| head and neck squamous cell carcinoma (HNSCC) | + |
| melanoma (MEL) | ++++ |
| non-Hodgkin lymphoma (NHL) | + |
| non-small cell lung cancer adenocarcinoma (NSCLCadeno) | + |
| NSCLC samples that cannot unambiguously be assigned to NSCLC adeno or NSCLCsquam (NSCLCother) | ++ |
| squamous cell non-small cell lung cancer (NSCLCsquam) | ++ |
| ovarian cancer (OC) | +++ |
| esophageal cancer (OSCAR) | + |
| renal cell carcinoma (RCC) | ++ |
| small cell lung cancer (SCLC) | ++ |
| urinary bladder carcinoma (UBC) | + |
| uterine and endometrial cancer (UEC) | ++++ |

ITEMS

1. An antigen binding protein specifically binding to a PRAME antigenic peptide that comprises or consists of the amino acid sequence SLLQHLIGL of SEQ ID NO: 50 and is in a complex with a major histocompatibility complex (MHC) protein, the antigen binding protein comprising
    (a) a first polypeptide comprising a variable domain $V_A$ comprising complementarity determining regions (CDRs) CDRa1. CDRa2 and CDRa3, wherein the CORa1 comprises or consists of the amino acid sequence VKEFQD (SEQ ID NO: 16), or an amino acid sequence differing from SEQ ID NO: 16 by one, two or three amino acid mutations, preferably amino acid substitutions, and the CDRa3 comprises or consists of the amino acid sequence of ALYNNLDMR (SEQ ID NO: 33) or ALYNNYDMR (SEQ ID NO: 34), or an amino acid sequence differing from SEQ ID NO: 33 or SEQ ID NO: 34 by one, two or three, preferably one or two, amino acid mutations, preferably amino acid substitutions, and (b) a second polypeptide comprising a variable domain $V_B$ comprising CDRb1, CDRb2 and CDRb3, wherein
        the CDRb1 comprises or consists of the amino acid sequence SGHNS (SEQ ID NO: 10) or an amino acid sequence differing from SEQ ID NO: 10 by one or two amino acid mutations, preferably amino acid substitutions, and
        the CDRb3 comprises or consists of the amino acid sequence $ASSX_1GX_2X_3DX_4QY$ (SEQ ID NO: 327), wherein $X_1$ is P, A or T, $X_2$ is A or S, $X_3$ is T or I, and $X_4$ is K or A, or an amino acid sequence differing from SEQ ID NO: 327 by one, two or three amino acid mutations, preferably amino acid substitutions.
2. The antigen binding protein of item 1, wherein
    (a) the CDRa2 comprises or consists of the amino acid sequence FGPYGKE (SEQ ID NO: 32), or an amino acid sequence differing from SEQ ID NO: 32 by one, two or three amino acid mutations, preferably amino acid substitutions, and/or
    (b) the CDRb2 comprises or consists of the amino acid sequence FQNTAV (SEQ ID NO: 36) or a CDRb2 amino acid sequence differing from SEQ ID NO: 36 by one, two, three, four, five or six amino acid mutations, preferably amino acid substitutions.
3. The antigen binding protein of item 1 or 2, wherein
    Position 27 of CDRa1 according to IMGT is V or is substituted by an amino acid selected from L, I, M, F, A, T, N, Q, H, E, D and S, particularly selected from T, N, S and I,
    Position 28 of CDRa1 according to IMGT is K or is substituted by an amino acid selected from R, Q, H, N, A, V, S, G, L, I and T, particularly selected from R. A and S,
    Position 38 of CORa1 according to IMGT is D or is substituted by an amino acid selected from E, N, Q, H, K and R, particularly N,
    Position 64 of CDRa2 according to IMGT is K or is substituted by an amino acid selected from R, Q, H, N, T, V, A, L, I, M and F, particularly selected from R, T and V,
    Position 114 of CDRa3 according to IMGT is L or Y or is substituted by an amino acid selected from M, W, H, Q, A, I, K, R, V, D, E, F and N particularly selected from H, Q, A, I, K, R, V, D, E, F and N, more particularly selected from H, Q, A and I,
    Position 56 of CDRb2 according to IMGT is F or is substituted by an amino acid selected from Y, M, L, W, H, V, I and A, particularly selected from Y, M and L,
    Position 57 of CDRb2 according to IMGT is Q or is substituted by an amino acid selected from N, R, D, E, Q, H, K and K, particularly N, with the proviso that the amino acid at position 57 is not N when the amino acid at position 63 is T or S,
    Position 58 of CDRb2 according to IMGT is N or is substituted by an amino acid selected from Q, H, D, K, R, S and T, particularly S.
    Position 63 of CDRb2 according to IMGT is T or is substituted by an amino acid selected from S, V, A, D, Q and E, particularly selected from S and E, with the proviso that the amino acid at position 63 is not T or S when the amino add at position 57 is N,
    Position 64 of CDRb2 according to IMGT is A or is substituted by an amino acid selected from V, L, I, S, G and T, particularly T, Position 65 of CDRb2 according to IMGT is V or is substituted by an amino acid selected from L, I, M, A, T, F and S, particularly selected from I, L and T, Position 108 of CDRb3 according to IMGT is P, A or T or is substituted by an amino acid selected from V, L, I, S, G, R, K, N and Q, particularly selected from R and S, with the proviso that the amino acid at position 108 is not N when the amino acid at position 110 is T or S.

Position 110 of CDRb3 according to IMGT is A or S or is substituted by an amino acid selected from V, L, I, G, T and C, particularly T, with the proviso that the amino acid at position 110 is not T or S when the amino acid at position 108 is N, Position 113 of CDRb3 according to IMGT is T or I or is substituted by an amino acid selected from V, L, and G, and Position 115 of CDRb3 according to IMGT is T, K or A or is substituted by an amino acid selected from G, L, I, V, R, Q, N, Y, H, E and F, particularly selected from L, I, V, R, Q, N, Y, H, E and F, more particularly from L, I, V and R.

4. The antigen binding protein of any one of items 1 to 3, wherein said antigen binding protein specifically binds to the amino acid sequence of SEQ ID NO: 50 in a complex with a MHC protein, in particular a HLA protein, more particularly HLA-A, even more particularly HLA-A*02.

5. The antigen binding protein of any one of items 1 to 4, wherein said antigen binding protein specifically binds to a functional epitope comprising or consisting of at least 3, 4 or 5 amino acid positions selected from the group consisting of positions 3, 5, 6, 7 and 8, in particular 3, 5 and 7, of SEQ ID NO: 50, preferably to a functional epitope consisting of amino acid positions 3, 5 and 7, or 3, 5, 6 and 7, or 3, 5, 7 and 8, or 3, 5, 6, 7 and 8 of SEQ ID NO: 50, but preferably not amino acid positions 1 and 4 of SEQ ID NO: 50.

6. The antigen binding protein of any one of items 1 to 4, wherein said antigen binding protein specifically binds to a functional epitope comprising or consisting of at least 6 or 7 amino acid positions selected from the group consisting of positions 1, 3, 4, 5, 6, 7 and 8 of SEQ ID NO: 50.

7. The antigen binding protein of any one of items 1 to 6, wherein said antigen binding protein binds to a complex of said PRAME antigenic peptide and a MHC protein, in particular a HLA protein, more particularly HLA-A, even more particularly HLA-A*02, with a $K_D$ of ≤100 nM, ≤50 nM, ≤10 nM, preferably ≤5 nM.

8. The antigen binding protein of any one of items 1 to 7, wherein said antigen binding protein does not significantly bind to at least 1, at least 2, at least 3, at least 4, at least 5, at least 10, at least 20 or all similar peptides selected from the group consisting of TMED9-001 (SEQ ID NO: 51), CAT-001 (SEQ ID NO: 52), DDX60L-001 (SEQ ID NO: 53), LRRC70-001 (SEQ ID NO: 54), PTPLB-001 (SEQ ID NO: 55), HDAC5-001 (SEQ ID NO: 56), VPS138-002 (SEQ ID NO: 57), ZNF318.001 (SEQ ID NO: 58), CCDC51-001 (SEQ ID NO: 59), IFT17-003 (SEQ ID NO: 60), DIAPH1-004 (SEQ ID NO: 62), FADS2-001 (SEQ ID NO: 63), FRYL-003 (SEQ ID NO: 64), GIMAP8-001 (SEQ ID NO: 65), HSF1-001 (SEQ ID NO: 66), KNT-001 (SEQ ID NO: 67), MAU-001 (SEQ ID NO: 68), MCM4-001 (SEQ ID NO: 69), MPPE1-001 (SEQ ID NO: 71), MYO1 &002 (SEQ ID NO: 72), PRR12-001 (SEQ ID NO: 73), PTRF-003 (SEQ ID NO: 74), RASGRP1-001 (SEQ ID NO: 75), SMARCD1-001 (SEQ ID NO: 76), TGM2-001 (SEQ ID NO: 77), VAV1-001 (SEQ ID NO: 78), VIM-009 (SEQ ID NO: 317), FARSA-001 (SEQ ID NO: 306), ALOX158-003 (SEQ ID NO: 304), FAM114A2-002 (SEQ ID NO: 305), GPR56-002 (SEQ ID NO: 307), IGHD-002 (SEQ ID NO: 308), NOMAP-3-0972 (SEQ ID NO: 309), NOMAP-3-1265 (SEQ ID NO: 310), NOMAP-3-1408 (SEQ ID NO: 311), NOMAP-3-1587 (SEQ ID NO: 312), NOMAP-3-1768 (SEQ ID NO: 313), NOMAP-5-0765 (SEQ ID NO: 314), PDCD10-004 (SEQ ID NO: 315), TSN-001 (SEQ ID NO: 316), ARMC9-002 (SEQ ID NO: 187), CLI-001 (SEQ ID NO: 188), COPG1-001 (SEQ ID NO: 190), COPS7A-001 (SEQ ID NO: 192), EIF-009 (SEQ ID NO: 194), EXT2-006 (SEQ ID NO: 196), LMNA-001 (SEQ ID NO: 198), PKM-005 (SEQ ID NO: 200), PSMB3-002 (SEQ ID NO: 202), RPL-007 (SEQ ID NO: 204). SPATS2L-003 (SEQ ID NO: 206). SYNE1-002 (SEQ ID NO: 208), TGM2-002 (SEQ ID NO: 210) and TPR-004 (SEQ ID NO: 212), in a complex with a MHC protein, preferably said antigen binding protein does not significantly bind to IFT17-003 (SEQ ID NO: 60) in a complex with a MHC protein.

9. The antigen binding protein of any one of items 1 to 8, wherein the antigen binding protein is multispecific, e.g. tetra-, tri- or bispecific, preferably bispecific, in particular said antigen binding protein is a bispecific TCR, a bispecific antibody or a bispecific TCR-antibody molecule.

10. The antigen binding protein of any one of items 1 to 9, wherein the first and the second polypeptide are comprised in a single polypeptide chain or two polypeptide chains, preferably wherein $V_A$ is comprised in a first polypeptide chain and $V_B$ is comprised in a second polypeptide chain.

11. The antigen binding protein of any one of items 1 to 10, wherein $V_A$ further comprises one or more framework regions, preferably all framework regions, selected from the group consisting of FR1-a, FR2-a, FR3-a and FR4-a, wherein FR1-a comprises or consists of the amino acid sequence of SEQ ID NO: 345 or SEQ ID NO: 346, or an amino acid sequence at least 85%, 90% or 95% identical to SEQ ID NO: 345, preferably comprising K or N, more preferably K, at position 20 and/or L or M more preferably L, at position 2;

FR2-a comprises or consists of the amino acid sequence of SEQ ID NO: 347 or SEQ ID NO: 348, or an amino acid sequence at least 85%, 90% or 95% identical to SEQ ID NO: 347, preferably comprising L, I or M, more preferably L or I, at position 39, A or D, more preferably A, at position 47, K or W, preferably K, at position 44, F or A, preferably $F_c$ at position 52 and/or Y or V, preferably Y, at position 55;

FR3-a comprises or consists of the amino acid sequence of SEQ ID NO: 349 or an amino acid sequence at least 85%, 90% or 95% identical to SEQ ID NO: 349, preferably comprising T or K, more preferably T, at position 92 and/or D or G, preferably D, at position 93;

FR4-a comprises or consists of the amino acid sequence of SEQ ID NO: 350 or an amino acid sequence at least 85%, 90% or 95% identical to SEQ ID NO: 350; and $V_B$ further comprises one or more framework regions, preferably all framework regions, selected from the group consisting of FR1-b, FR2-b, FR3-b and FR4-b, wherein FR1-b comprises or consists of the amino acid sequence of SEQ ID NO: 351 or SEQ ID NO: 352 or an amino acid sequence at least 85%, 90% or 95% identical to SEQ ID NO: 351, preferably comprising H or N, more preferably H, at position 10, E, L or K, preferably E, at position 11 and/or R or H, at position 22;

FR2-b comprises or consists of the amino acid sequence of SEQ ID NO: 353 or an amino acid sequence at least 85%, 90% or 95% identical to SEQ ID NO: 353, preferably comprising R or K, more preferably R, at position 43, E or Q, preferably E, at position 44, M or P, more preferably P, at position 46, and/or R or Q, more preferably Q, at position 48;

FR3-b comprises or consists of the amino acid sequence of SEQ ID NO: 354 or SEQ ID NO: 355 or an amino acid sequence at least 85%, 90% or 95% identical to SEQ ID NO: 354, preferably comprising D, A, E, R, K Q, N or S, more preferred D, A, E, Q, N or S, more preferably D or A, even more preferably D, at position 84; and FR4-b comprises or consists of the amino acid sequence of SEQ ID NO: 356 or an amino acid sequence at least 85%, 90% or 95% identical to SEQ ID NO: 356.

12. The antigen binding protein of any one of items 1 to 11, wherein $V_A$ comprises or consists of the amino acid sequence of SEQ ID NO: 132 or an amino acid sequence at least 85%, 90% or 95% identical to SEQ ID NO: 132, preferably comprising a CDRa1 of SEQ ID NO: 16, a CDRa2 of SEQ ID NO: 32 and a CDRa3 of SEQ ID NO: 33, SEQ ID NO: 34, or SEQ ID NO: 9, and further K or N, preferably K, at position 20, L, M, or I, preferably L or I, at position 39, K or W, preferably K, at position 44, F or A, preferably F, at position 52, Y or V, preferably Y, at position 55, T or K, preferably T, at position 92 and/or D or G, preferably D, at position 93; and $V_B$ comprises or consists of the amino acid sequence of SEQ ID NO: 134 or an amino acid sequence at least 85%, 90% or 95% identical to SEQ ID NO: 134, preferably comprising a CDRb1 of SEQ ID NO: 10, a CDRb2 of SEQ ID NO: 36, and a CDRb3 of SEQ ID NO: 48, SEQ ID NO: 49, SEQ ID NO: 47, SEQ ID NO: 281, SEQ ID NO: 292. SEQ ID NO: 294, SEQ ID NO: 297, SEQ ID NO: 298, SEQ ID NO: 301 or SEQ ID NO: 283, and further E, L or K, preferably E, at position 11, R or H at position 22. E or Q, preferably E, at position 44, P or M, preferably P, at position 46, Q or R, preferably Q, at position 48 and/or D, A, E, Cr, N, or S, preferably D or A, at position 84.

13. The antigen binding protein of any one of items 1 to 12, wherein $V_A$ comprises or consists of the amino acid sequence of SEQ ID NO: 132, SEQ ID NO: 129, SEQ ID NO: 137 or SEQ ID NO: 142, and $V_B$ comprises or consists of the amino acid sequence of SEQ ID NO: 134, SEQ ID NO: 130, SEQ ID NO: 135, SEQ ID NO: 136, SEQ ID NO: 138, SEQ ID NO: 139, SEQ ID NO: 140, SEQ ID NO: 141, SEQ ID NO: 144, SEQ ID NO: 145. SEQ ID NO: 146, SEQ ID NO: 147 or SEQ ID NO:148.

14. The antigen binding protein of any of items 1 to 13, further comprising one or more of the following:
    (i) one or more further antigen binding sites;
    (ii) a transmembrane region, optionally including a cytoplasmic signalling region;
    (iii) a diagnostic agent;
    (iv) a therapeutic agent; and
    (v) PK modifying moiety.

15. The antigen binding protein of any one of items 1 to 14, further comprising an antibody light chain variable domain ($V_L$) and an antibody heavy chain variable domain ($V_H$).

16. The antigen binding protein of item 15, wherein VL and VH bind to an antigen selected from the group consisting of CD2, CD3, in particular CD3γ, CD345, and/or CD3e, CD4, CD5, CD7, CD8, CD10, CD11b, CD11c, CD14, CD16, CD18, CD22, CD25, CD28, CD32a, CD32b, CD33, CD41, CD41b, CD42a, CD42b, CD44, CD45RA, CD49, CD55, CD56, CD61, CD64, CD68, CD90, CD94, CD95, CD117, CD123, CD125, CD134, CD137, CD152, CD163, CD193, CD203c, CD235a, CD278, CD279, CD287, Nkp46, NKG2D, GITR, $F_c$εRI, TCRα/β and TCRγ/δ, HLA-DR and 4-1 BB, or combinations thereof and/or bind to an effector cell, in particular a T cell or natural killer cell (NK cell).

17. The antigen binding protein of item 15 or 16, wherein the antigen binding protein comprises a first and a second polypeptide chain.
    wherein
    the first polypeptide chain is represented by a formula [Ia]:

$$V_1\text{-}L_1\text{-}D_1\text{-}L_2\text{-}V_2\text{-}L_3\text{-}D_2 \qquad \text{[Ia]},$$

and the second polypeptide chain is represented by a formula [IIa]

$$V_3\text{-}L_4\text{-}D_3\text{-}L_5\text{-}V_4\text{-}L_6\text{-}D_4 \qquad \text{[IIa]},$$

wherein
    $V_1$, $V_2$, $V_3$, and $V_4$ are variable domains, wherein one of $V_1$ to $V_4$ is $V_A$, one is $V_B$, one is $V_L$ and one is $V_H$;
    $D_1$, $D_2$, $D_3$, and $D_4$ are dimerization domains and may be present or absent, wherein $D_1$ and $D_3$, and $D_2$ and 04, specifically bind to each other and at least one pair of $D_1$ and $D_3$, or $D_2$ and $D_4$ is present; and
    $L_1$, $L_2$, $L_3$, $L_4$, $L_5$, and $L_6$ are linkers, wherein $L_1$ and $L_4$ are present and $L_2$, $L_3$, $L_5$, and $L_6$ may be present or absent.

18. The antigen binding protein of any of items 15 to 17, wherein the antigen binding protein comprises a first and a second polypeptide chain,
    wherein
    the first polypeptide chain is represented by a formula [Ib]:

$$V_1\text{-}L_1\text{-}V_2\text{-}L_3\text{-}D_2 \qquad \text{[Ib]},$$

and the second polypeptide chain is represented by a formula [IIb]:

$$V_3\text{-}L_4\text{-}V_4\text{-}L_6\text{-}D_4 \qquad \text{[IIb]},$$

wherein
    $V_1$, $V_2$, $V_3$, $V_4$, are variable domains, preferably wherein one of $V_1$ and $V_2$ is $V_A$, one of $V_3$ and $V_4$ is $V_A$ and of the remaining two variable domains one is $V_L$ and the other is $V_H$;

$D_2$ and $D_4$ are dimerization domains, preferably $F_c$-domains; and $L_1$, $L_3$, $L_4$ and $L_6$ are linkers, wherein $L_3$, and $L_6$ may be present or absent.

19. The antigen binding protein of item 17 or 18, wherein (1) $V_1$ is $V_H$, $V_2$ is $V_B$, $V_3$ is $V_A$, and $V_4$ is $V_L$;

(2) $V_1$ is $V_B$, $V_2$ is $V_H$, $V_3$ is $V_L$, and $V_4$ is $V_A$;

(3) $V_1$ is $V_B$, $V_2$ is $V_L$, $V_3$ is $V_H$, and $V_4$ is $V_A$;

(4) $V_1$ is $V_L$, $V_2$ is $V_B$, $V_3$ is $V_A$, and $V_4$ is $V_H$;

(5) $V_1$ is $V_H$, $V_2$ is $V_B$, $V_3$ is $V_1$, and $V_4$ is $V_A$;

(6) $V_1$ is $V_B$, $V_2$ is $V_H$, $V_3$ is $V_A$, and $V_4$ is $V_L$;

(7) $V_1$ is $V_L$, $V_2$ is $V_B$, $V_3$ is $V_H$, and $V_4$ is $V_A$;

(8) $V_1$ is $V_B$, $V_2$ is $V_1$, $V_3$ is $V_A$, and $V_4$ is $V_H$;

(9) $V_1$ is $V_H$, $V_2$ is $V_L$, $V_3$ is $V_A$, and $V_4$ is $V_B$;

(10) $V_L$ is $V_L$, $V_2$ is $V_H$, $V_3$ is $V_A$, and $V_4$ is $V_B$;

(11) $V_1$ is $V_H$, $V_2$ is $V_L$, $V_3$ is $V_B$, and $V_4$ is $V_A$: or

(12) $V_L$ is $V_L$, $V_2$ is $V_H$, $V_3$ is $V_B$, and $V_4$ is $V_A$.

20. The antigen binding protein of any one of items 1 to 19, comprising a first polypeptide chain selected from SEQ ID NO: 100, 103, 105, 106, 111, 122, 126, 128, 151, 155, 156,157, 158, 159, 166, 167, 169, 171, 173, 175, 177, 178, 179, 180, 181, 183, 189, 191,193, 195, 197, 199, 201, 203, 205, 207, 209, 211, 213, 215, 217, 285, 291, 295, 299 and 303, and a second polypeptide chain selected from SEQ ID NO: 101, 102, 104, 107, 110, 119, 121, 131, 133, 143, 152,160, 161, 162, 163, 164, 165, 168, 170, 172, 174, 176, 182, 184, 185, 186, 216, 218, 220, 222, 224, 228, 230, 232, 234, 236, 238, 240, 242, 244, 246, 248, 250, 252, 254, 256, 258, 260, 262, 264, 266, 268, 270, 272, 274, 276, 278, 282, 284, 296 or 300.

21. The antigen binding protein of any one of items 1 to 13, wherein $V_A$ is comprised in a TCR α- or γ-chain: and/or $V_B$ is comprised in a TCR β- or α-chain.

22. An isolated nucleic acid comprising a sequence encoding the antigen binding protein of any one of items 1 to 21.

23. A vector comprising the nucleic acid of item 22.

24. A host cell comprising the antigen binding protein of any one of items 1 to 21, or the nucleic acid of item 22, or the vector of item 23.

25. The host cell of item 24, wherein the host cell is
a lymphocyte, preferably a T lymphocyte or T lymphocyte progenitor cell, for example a CD4 or CD8 positive T cell or
a cell for recombinant expression, such as a Chinese Hamster Ovary (CHO) cell or a yeast cell.

26. A pharmaceutical composition comprising the antigen binding protein of any one of items 1 to 21, the nucleic acid of item 22, the vector of item 23, or the host cell of item 24 or 25 and a pharmaceutically acceptable carrier.

27. A method of producing the antigen binding protein according to any one of items 1 to 21, comprising
a. providing a host cell,
b. providing a genetic construct comprising a coding sequence encoding the antigen binding protein of any of items 1 to 21,
c. introducing said genetic construct into said host cell, and
d. expressing said genetic construct by said host cell.

28. The method of item 27, further comprising the isolation and purification of the antigen binding protein from the host cell and, optionally, reconstitution of the antigen binding protein in a T cell.

29. The antigen binding protein of any one of items 1 to 21, the nucleic acid of item 22, the vector of item 23, the host cell of item 24 or 25, or the pharmaceutical composition of item 26 for use in medicine.

29. The antigen binding protein of any one of items 1 to 21, the nucleic acid of item 22 or the vector of item 23, the host cell of item 24 or 25 or the pharmaceutical composition of item 26 for use in the diagnosis, prevention, and/or treatment of a proliferative disease, such as cancer, wherein said cancer is selected from the group of cancers consisting of acute myeloid leukemia, breast cancer, cholangiocellular carcinoma, gallbladder cancer, glioblastoma, hepatocellular carcinoma, head and neck squamous cell carcinoma, melanoma, amelanotic melanoma, non-Hodgkin lymphoma, non-small cell lung cancer adenocarcinoma, non-small cell lung cancer, squamous cell non-small cell lung cancer, ovarian cancer, esophageal cancer, renal cell carcinoma, small cell lung cancer, urinary bladder carcinoma, uterine and endometrial cancer, osteosarcoma, chronic lymphocytic leukemia, colorectal carcinoma, and synovial sarcoma.

---

SEQUENCE LISTING (384 sequences)

SEQ ID NO: 1 - protein, 251 aa, Artificial Sequence
  Modified or unmodified human sequence
ILNVEQSPQSLHVQEGDSTNFTCSFPSSNFYALHWYRWETAKSPEALFVMTLNGDEKKKGRISATLNTKEGYSYLYIKGSQPEDSATYLCALYNNNDMRFGAGTRLTVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 2 - protein, 290 aa, Artificial Sequence
  Modified or unmodified human sequence
GVIQSPRHEVTEMGQEVTLRCKPISGHNSLFWYRQTMMRGLELLIYFNNNVPIDDSGMPEDRFSAKMPNASFSTLKIQPSEPRDSAVYFCASSPGSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 3 - protein, 110 aa, Artificial Sequence
  Modified or unmodified human sequence
ILNVEQSPQSLHVQEGDSTNFTCSFPSSNFYALHWYRWETAKSPEALFVMTLNGDEKKKGRISATLNTKEGYSYLYIKGSQPEDSATYLCALYNNNDMRFGAGTRLTVKP

SEQ ID NO: 4 - protein, 111 aa, Artificial Sequence
  Modified or unmodified human sequence
GVIQSPRHEVTEMGQEVTLRCKPISGHNSLFWYRQTMMRGLELLIYFNNNVPIDDSGMPEDRFSAKMPNASFSTLKIQPSEPRDSAVYFCASSPGSTDTQYFGPGTRLTVL

SEQ ID NO: 5 - protein, 246 aa, Artificial Sequence
  Modified or unmodified human sequence
ILNVEQSPQSLHVQEGDSTNFTCSFPSSNFYALHWYRWETAKSPEALFVMTLNGDEKKKGRISATLNTKEGYSYLYIKGSQPEDSATYLCALYNNNDMRFGAGTRLTVKPGGGGSGGGGSGGGGSGGGGSGGGGSGVIQSPRHEVTEMGQEVTLRCKPISGHNSLFWYRQTMMRGLELLIYFNNNVPIDDSGMPEDRFSAKMPNASFSTLKIQPSEPRDSAVYFCASSPGSTDTQYFGPGTRLTVL

SEQ ID NO: 6 - protein, 246 aa, Artificial Sequence
  Modified or unmodified human sequence
ILNVEQSPQSLHVQEGDSTNFTCSFPSSNFYNLHWYRKETAKSPEFLFYMTSNGDEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFNNNEPIDDSGMPEDRFSAKMPNASFSTLKIQPSEPRDSAVYFCASSPGSTDTQYFGPGTRLTVL

SEQ ID NO: 7 - protein, 6 aa, Artificial Sequence
  Modified or unmodified human sequence
SSNFYA

SEQ ID NO: 8 - protein, 7 aa, Artificial Sequence
  Modified or unmodified human sequence
MTLNGDE

SEQ ID NO: 9 - protein, 9 aa, Artificial Sequence
  Modified or unmodified human sequence
ALYNNNDMR

SEQ ID NO: 10 - protein, 5 aa, Artificial Sequence
  Modified or unmodified human sequence
SGHNS

SEQ ID NO: 11 - protein, 6 aa, Artificial Sequence
  Modified or unmodified human sequence
FNNNVP

SEQ ID NO: 12 - protein, 11 aa, Artificial Sequence
  Modified or unmodified human sequence
ASSPGSTDTQY

SEQ ID NO: 13 - protein, 6 aa, Artificial Sequence
  Modified or unmodified human sequence
SSNFYN

SEQ ID NO: 14 - protein, 7 aa, Artificial Sequence
  Modified or unmodified human sequence
MTSNGDE

SEQ ID NO: 15 - protein, 6 aa, Artificial Sequence
  Modified or unmodified human sequence
FNNNEP

SEQ ID NO: 16 - protein, 6 aa, Artificial Sequence
  Modified or unmodified human sequence
VKEFQD

SEQ ID NO: 17 - protein, 6 aa, Artificial Sequence
  Modified or unmodified human sequence
NKEFQD

SEQ ID NO: 18 - protein, 6 aa, Artificial Sequence
  Modified or unmodified human sequence
TREFQD

SEQ ID NO: 19 - protein, 6 aa, Artificial Sequence
  Modified or unmodified human sequence
NREFQD

SEQ ID NO: 20 - protein, 6 aa, Artificial Sequence
  Modified or unmodified human sequence
TSEFQD

SEQ ID NO: 21 - protein, 6 aa, Artificial Sequence
  Modified or unmodified human sequence
TKEFQD

SEQ ID NO: 22 - protein, 6 aa, Artificial Sequence
  Modified or unmodified human sequence
VREFQD

SEQ ID NO: 23 - protein, 6 aa, Artificial Sequence
  Modified or unmodified human sequence
TAEFQD

SEQ ID NO: 24 - protein, 6 aa, Artificial Sequence
  Modified or unmodified human sequence
VSEFQD

SEQ ID NO: 25 - protein, 6 aa, Artificial Sequence
  Modified or unmodified human sequence
VAEFQD

SEQ ID NO: 26 - protein, 6 aa, Artificial Sequence
  Modified or unmodified human sequence
IKEFQN

SEQ ID NO: 27 - protein, 6 aa, Artificial Sequence
  Modified or unmodified human sequence
VREFQN

SEQ ID NO: 28 - protein, 6 aa, Artificial Sequence
  Modified or unmodified human sequence
TAEFQN

SEQ ID NO: 29 - protein, 7 aa, Artificial Sequence
  Modified or unmodified human sequence
FGPYGVE

SEQ ID NO: 30 - protein, 7 aa, Artificial Sequence
  Modified or unmodified human sequence
FGPYGRE

SEQ ID NO: 31 - protein, 7 aa, Artificial Sequence
  Modified or unmodified human sequence
FGPYGTE

SEQ ID NO: 32 - protein, 7 aa, Artificial Sequence
  Modified or unmodified human sequence
FGPYGKE

SEQ ID NO: 33 - protein, 9 aa, Artificial Sequence
  Modified or unmodified human sequence
ALYNNLDMR

SEQ ID NO: 34 - protein, 9 aa, Artificial Sequence
  Modified or unmodified human sequence
ALYNNYDMR

SEQ ID NO: 35 - protein, 6 aa, Artificial Sequence
  Modified or unmodified human sequence
YQNTAI

SEQ ID NO: 36 - protein, 6 aa, Artificial Sequence
  Modified or unmodified human sequence
FQNTAV

SEQ ID NO: 37 - protein, 6 aa, Artificial Sequence
  Modified or unmodified human sequence
YQNTAV

SEQ ID NO: 38 - protein, 6 aa, Artificial Sequence
  Modified or unmodified human sequence
YQNTAL

SEQ ID NO: 39 - protein, 6 aa, Artificial Sequence
  Modified or unmodified human sequence
FQNTAT

SEQ ID NO: 40 - protein, 6 aa, Artificial Sequence
  Modified or unmodified human sequence
MQNSAV

SEQ ID NO: 41 - protein, 6 aa, Artificial Sequence
  Modified or unmodified human sequence
FQNTAL

SEQ ID NO: 42 - protein, 6 aa, Artificial Sequence
  Modified or unmodified human sequence
MQNTAI

SEQ ID NO: 43 - protein, 6 aa, Artificial Sequence
  Modified or unmodified human sequence
LQNTAV

SEQ ID NO: 44 - protein, 6 aa, Artificial Sequence
  Modified or unmodified human sequence
MQNTAV

SEQ ID NO: 45 - protein, 6 aa, Artificial Sequence
  Modified or unmodified human sequence
FNSETV

SEQ ID NO: 46 - protein, 11 aa, Artificial Sequence
  Modified or unmodified human sequence
ASSPGSIDTQY

SEQ ID NO: 47 - protein, 11 aa, Artificial Sequence
  Modified or unmodified human sequence
ASSPGATDTQY

SEQ ID NO: 48 - protein, 11 aa, Artificial Sequence
  Modified or unmodified human sequence
ASSPGATDKQY

SEQ ID NO: 49 - protein, 11 aa, Artificial Sequence
  Modified or unmodified human sequence
ASSPGSTDAQY

SEQ ID NO: 50 - protein, 9 aa, Artificial Sequence
  Modified or unmodified human sequence
SLLQHLIGL

SEQ ID NO: 51 - protein, 9 aa, Artificial Sequence
  Modified or unmodified human sequence
SILQTLILV

SEQ ID NO: 52 - protein, 9 aa, Artificial Sequence
  Modified or unmodified human sequence
SLIEHLQGL

SEQ ID NO: 53 - protein, 9 aa, Artificial Sequence
  Modified or unmodified human sequence
SLIQHLEEI

SEQ ID NO: 54 - protein, 9 aa, Artificial Sequence
  Modified or unmodified human sequence
SLLKNLIYL

SEQ ID NO: 55 - protein, 9 aa, Artificial Sequence
  Modified or unmodified human sequence
SLLNHLPYL

SEQ ID NO: 56 - protein, 9 aa, Artificial Sequence
  Modified or unmodified human sequence
SLLQHVLLL

SEQ ID NO: 57 - protein, 9 aa, Artificial Sequence
  Modified or unmodified human sequence
SLLQKQIML

SEQ ID NO: 58 - protein, 9 aa, Artificial Sequence
  Modified or unmodified human sequence
SLSQELVGV

SEQ ID NO: 59 - protein, 9 aa, Artificial Sequence
  Modified or unmodified human sequence
SVLGALIGV

SEQ ID NO: 60 - protein, 9 aa, Artificial Sequence
  Modified or unmodified human sequence
FMNPHLISV

SEQ ID NO: 61 - protein, 25 aa, Artificial Sequence
  Modified or unmodified human sequence
GGGGSGGGGSGGGGSGGGGSGGGGS

SEQ ID NO: 62 - protein, 9 aa, Artificial Sequence
  Modified or unmodified human sequence
SILQHLLLV

SEQ ID NO: 63 - protein, 9 aa, Artificial Sequence
  Modified or unmodified human sequence
LLLAHIIAL

SEQ ID NO: 64 - protein, 9 aa, Artificial Sequence
  Modified or unmodified human sequence
HLLSKLISV

SEQ ID NO: 65 - protein, 9 aa, Artificial Sequence
  Modified or unmodified human sequence
KLLKNLIGI

SEQ ID NO: 66 - protein, 9 aa, Artificial Sequence
  Modified or unmodified human sequence
KLIQFLISL

SEQ ID NO: 67 - protein, 9 aa, Artificial Sequence
  Modified or unmodified human sequence
YMLEHVITL

SEQ ID NO: 68 - protein, 9 aa, Artificial Sequence
  Modified or unmodified human sequence
ILLEHIIMC

SEQ ID NO: 69 - protein, 9 aa, Artificial Sequence
  Modified or unmodified human sequence
SILEHQIQV

SEQ ID NO: 70 - protein, 20 aa, Artificial Sequence
  Modified or unmodified human sequence
GGGGSGGGGSGGGGSGGGGS

SEQ ID NO: 71 - protein, 9 aa, Artificial Sequence
  Modified or unmodified human sequence
SLLLKLIAV

SEQ ID NO: 72 - protein, 9 aa, Artificial Sequence
  Modified or unmodified human sequence
SLLDNMIGV

SEQ ID NO: 73 - protein, 9 aa, Artificial Sequence
  Modified or unmodified human sequence
FLIQHLLQA

SEQ ID NO: 74 - protein, 9 aa, Artificial Sequence
  Modified or unmodified human sequence
SLLDKIIGA

SEQ ID NO: 75 - protein, 9 aa, Artificial Sequence
  Modified or unmodified human sequence
ELLQKVITL

SEQ ID NO: 76 - protein, 9 aa, Artificial Sequence
  Modified or unmodified human sequence
IIINHVISV

SEQ ID NO: 77 - protein, 9 aa, Artificial Sequence
  Modified or unmodified human sequence
FVLGHFILL

SEQ ID NO: 78 - protein, 9 aa, Artificial Sequence
  Modified or unmodified human sequence
NLLPHAINL

SEQ ID NO: 79 - protein, 246 aa, Artificial Sequence
  Modified or unmodified human sequence
ILNVEQSPQSLHVQEGDSTNFTCSFPTREFQDLHWYRKETAKSPEFLFYFGPYGVEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGSTDTQYFGPGTRLTVL

SEQ ID NO: 80 - protein, 246 aa, Artificial Sequence
  Modified or unmodified human sequence
ILNVEQSPQSLHVQEGDSTNFTCSFPTKEFQDLHWYRKETAKSPEFLFYFGPYGVEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGATDTQYFGPGTRLTVL

SEQ ID NO: 81 - protein, 246 aa, Artificial Sequence
  Modified or unmodified human sequence
ILNVEQSPQSLHVQEGDSTNFTCSFPTREFQDLHWYRKETAKSPEFLFYFGPYGKEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLHCKPISGHNSLFWYRETPMQGLELLIYFQNTAVIDDSGMPEDRFSAKMPNASFSTLKIQPSEPRDSAVYFCASSPGSTDTQYFGPGTRLTVL

SEQ ID NO: 82 - protein, 246 aa, Artificial Sequence
  Modified or unmodified human sequence
ILNVEQSPQSLHVQEGDSTNFTCSFPTKEFQDLHWYRKETAKSPEFLFYFGPYGREKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGATDTQYFGPGTRLTVL

SEQ ID NO: 83 - protein, 246 aa, Artificial Sequence
  Modified or unmodified human sequence
ILNVEQSPQSLHVQEGDSTNFTCSFPSSNFYNLHWYRKETAKSPEFLFYFGPYGVEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFNSETVIDDSGMPEDRFSAKMPNASFSTLKIQPSEPRDSAVYFCASSPGATDTQYFGPGTRLTVL

SEQ ID NO: 84 - protein, 246 aa, Artificial Sequence
  Modified or unmodified human sequence
ILNVEQSPQSLHVQEGDSTNFTCSFPNKEFQDLHWYRKETAKSPEFLFYFGPYGVEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYYQNTAVIDDSGMPEDRFSAKMPNASFSTLKIQPSEPRDSAVYFCASSPGATDTQYFGPGTRLTVL

SEQ ID NO: 85 - protein, 246 aa, Artificial Sequence
  Modified or unmodified human sequence
ILNVEQSPQSLHVQEGDSTNFTCSFPNKEFQDLHWYRKETAKSPEFLFYFGPYGTEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGSTDTQYFGPGTRLTVL

SEQ ID NO: 86 - protein, 246 aa, Artificial Sequence
  Modified or unmodified human sequence
ILNVEQSPQSLHVQEGDSTNFTCSFPSSNFYNLHWYRKETAKSPEFLFYFGPYGKEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLHCKPISGHNSLFWYRETPMQGLELLIYYQNTAIIDDSGMPEDRFSAKMPNASFSTLKIQPSEPRDSAVYFCASSPGSTDTQYFGPGTRLTVL

SEQ ID NO: 87 - protein, 246 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGATDTQYFGPGTRLTVL

SEQ ID NO: 88 - protein, 87 aa, Artificial Sequence
  Modified or unmodified human sequence
MQLLRCFSIFSVIASVLAQELTTICEQIPSPTLESTPYSLSTTTILANGKAMQGVFEYYKSVTFVSNCGSHPSTTSKGSPINTQYVF

SEQ ID NO: 89 - protein, 246 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNNDMRFGAGTRLTVKPGGGGSGGGGSGGGGSGGGGSGGGGSGVIQSPRNLVTEMGQEVTLHCKPISGHNSLFWYRETPMQGLELLIYFNSETVIDDSGMPEDRFSAKMPNASFSTLKIQPSEPRDSAVYFCASSPGSTDTQYFGPGTRLTVL

SEQ ID NO: 90 - protein, 246 aa, Artificial Sequence
  Modified or unmodified human sequence
ILNVEQSPQSLHVQEGDSTNFTCSFPNKEFQDLHWYRKETDKSPEFLFYFGPYGREKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYKETPMQGLELLIYYQNTAVIDDSGMPEDRFSAKMPNASFSTLKIQPSEPRDSAVYFCASSPGATDTQYFGPGTRLTVL

SEQ ID NO: 91 - protein, 246 aa, Artificial Sequence
  Modified or unmodified human sequence
ILNVEQSPQSLHVQEGDSTNFTCSFPTREFQDLHWYRKETAKSPEFLFYFGPYGTEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYYQNTAVIDDSGMPEDRFSAKMPNASFSTLKIQPSEPRDSAVYFCASSSGATDTQYFGPGTRLTVL

SEQ ID NO: 92 - protein, 246 aa, Artificial Sequence
  Modified or unmodified human sequence
ILNVEQSPQSLHVQEGDSTNFTCSFPTKEFQDMHWYRKETAKSPEFLFYFGPYGVEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGSTDTQYFGPGTRLTVL

SEQ ID NO: 93 - protein, 214 aa, Artificial Sequence
  Modified or unmodified human sequence
DIQMTQSPSSLSASVGDRVTITCRASQDIRNYLNWYQQKPGKAPKLLIYYTSRLHSGVPSRFSGSGSGTDYTLTISSLQPEDIATYFCQQGQTLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - protein, 487 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPSPAPPVAGILNVEQSPQSLHVQEGDSTNFTCSFPTREFQDLHWYRKETAKSPEFLFYFGPYGVEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGSTDTQYFGPGTRLTVL

SEQ ID NO: 95 - protein, 487 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPSPAPPVAGILNVEQSPQSLHVQEGDSTNFTCSFPTKEFQDLHWYRKETAKSPEFLFYFGPYGREKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGATDTQYFGPGTRLTVL

SEQ ID NO: 96 - protein, 487 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPSPAPPVAGILNVEQSPQSLHVQEGDSTNFTCSFPSSNFYNLHWYRKETAKSPEFLFYFGPYGVEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFNSETVIDDSGMPEDRFSAKMPNASFSTLKIQPSEPRDSAVYFCASSPGATDTQYFGPGTRLTVL

SEQ ID NO: 97 - protein, 487 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPSPAPPVAGILNVEQSPQSLHVQEGDSTNFTCSFPNKEFQDLHWYRKETAKSPEFLFYFGPYGTEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGSTDTQYFGPGTRLTVL

SEQ ID NO: 98 - protein, 487 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPSPAPPVAGILNVEQSPQSLHVQEGDSTNFTCSFPVKEFQDLHWYRKETAKSPEFLFYFGPYGKEKKKGRISATLNTKEGYSYLYITDSQPEDSATYLCALYNNNDMRFGAGTRLTVKPGGGGSGGGGSGGGGSGGGGSGGGGSGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGATDTQYFGPGTRLTVL

SEQ ID NO: 99 - protein, 8 aa, Artificial Sequence
  Modified or unmodified human sequence
DYKDDDDK

SEQ ID NO: 100 - protein, 454 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNNDMRFGAGTRLTVKPGGGSGGGGDIQMTQSPSSLSASVGDRVTITCRASQDIRNYLNWYQQKPGKAPKLLIYYTSRLHSGVPSRFSGSGSGTDYTLTISSLQPEDIATYFCQQGQTLPWTFGQGTKVEIKEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 101 - protein, 470 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSGGGSGGGGGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGATDTQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 102 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGATDTQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 103 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNNDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 104 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHLVTEMGQEVTLRCKPISGHNSLFWYRETPMQGLELLIYFQNTAVIDDSGMPEDRFSAKMPNASFSTLKIQPSEPRDSAVYFCASSPGATDTQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 105 - protein, 472 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNNDMRFGAGTRLTVKPGGGSGGGGEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 106 - protein, 454 aa, Artificial Sequence
  Modified or unmodified human sequence
IMNVEQSPQSLHVQEGDSTNFTCSFPVKEFQDLHWYRKETAKSPEFLFYFGPYGKEKKKGRISATLNTKEGYSYLYITDSQPEDSATYLCALYNNNDMRFGAGTRLTVKPGGGSGGGGDIQMTQSPSSLSASVGDRVTITCRASQDIRNYLNWYQQKPGKAPKLLIYYTSRLHSGVPSRFSGSGSGTDYTLTISSLQPEDIATYFCQQGQTLPWTFGQGTKVEIKEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 107 - protein, 470 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSGGGSGGGGGVIQSPRHLVTEMGQEVTLRCKPISGHNSLFWYRETPMQGLELLIYFQNTAVIDDSGMPEDRFSAKMPNDSFSTLKIQPSEPRDSAVYFCASSPGATDTQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 108 - protein, 107 aa, Artificial Sequence
  Modified or unmodified human sequence
DIQMTQSPSSLSASVGDRVTITCRASQDIRNYLNWYQQKPGKAPKLLIYYTSRLHSGVPSRFSGSGSGTDYTLTISSLQPEDIATYFCQQGQTLPWTFGQGTKVEIK

SEQ ID NO: 109 - protein, 122 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSS

SEQ ID NO: 110 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHLVTEMGQEVTLRCKPISGHNSLFWYRETPMQGLELLIYFQNTAVIDDSGMPEDRFSAKMPNDSFSTLKIQPSEPRDSAVYFCASSPGATDTQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 111 - protein, 467 aa, Artificial Sequence
  Modified or unmodified human sequence
IMNVEQSPQSLHVQEGDSTNFTCSFPVKEFQDLHWYRKETAKSPEFLFYFGPYGKEKKKGRISATLNTKEGYSYLYITDSQPEDSATYLCALYNNNDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 112 - protein, 120 aa, Artificial Sequence
  Modified or unmodified human sequence
EVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSS

SEQ ID NO: 113 - protein, 106 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIK

SEQ ID NO: 114 - protein, 120 aa, Artificial Sequence
  Modified or unmodified human sequence
EVQLVQSGAEVKKPGASVKVSCKASGYKFTRYVMHWVRQAPGQGLEWMGYINPYNDVTKYAEKFQGRVTLTSDTSTSTAYMELSSLRSEDTAVHYCARGSYYDYEGFVYWGQGTLVTVSS

SEQ ID NO: 115 - protein, 120 aa, Artificial Sequence
  Modified or unmodified human sequence
EVQLVQSGAEVKKPGASVKVSCKASGYKFTSYVMHWVRQAPGQGLEWMGYINPRNDVTKYAEKFQGRVTLTSDTSTSTAYMELSSLRSEDTAVHYCARGSYYDYEGFVYWGQGTLVTVSS

SEQ ID NO: 116 - protein, 120 aa, Artificial Sequence
  Modified or unmodified human sequence
EVQLVQSGAEVKKPGASVKVSCKASGYKFTRYVMHWVRQAPGQGLEWMGYINPYNDVTKYAEKFQGRVTLTSDTSTSTAYMELSSLRSEDTAVYYCARGSYYDYEGFVYWGQGTLVTVSS

SEQ ID NO: 117 - protein, 120 aa, Artificial Sequence
  Modified or unmodified human sequence
EVQLVQSGAEVKKPGASVKVSCKASGYKFTSYVMHWVRQAPGQGLEWMGYINPRNDVTKYAEKFQGRVTLTSDTSTSTAYMELSSLRSEDTAVYYCARGSYYDYEGFVYWGQGTLVTVSS

SEQ ID NO: 118 - protein, 125 aa, Artificial Sequence
  Modified or unmodified human sequence
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 119 - protein, 470 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSGGGSGGGGGVIQSPRHLVTEMGQEVTLRCKPISGHNSLFWYRETPMQGLELLIYFQNTAVIDDSGMPEDRFSAKMPNDSFSTLKIQPSEPRDSAVYFCASSPGATDLQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 120 - protein, 109 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 121 - protein, 470 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDLQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 122 - protein, 454 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNNDMRFGAGTRLTVKPGGGSGGGGDIQMTQSPSSLSASVGDRVTITCRASQDIRNYLNWYQQKPGKAPKLLIYYTSRLHSGVPSRFSGSGSGTDYTLTISSLQPEDIATYFCQQGQTLPWTFGQGTKVEIKEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 123 - protein, 125 aa, Artificial Sequence
  Modified or unmodified human sequence
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGDSYISYWAYWGQGTLVTVSS

SEQ ID NO: 124 - protein, 454 aa, Artificial Sequence; identical to SEQ ID NO: 106
  Modified or unmodified human sequence

SEQ ID NO: 125 - protein, 125 aa, Artificial Sequence
  Modified or unmodified human sequence
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGESYISYWAYWGQGTLVTVSS

SEQ ID NO: 126 - protein, 454 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGDIQMTQSPSSLSASVGDRVTITCRASQDIRNYLNWYQQKPGKAPKLLIYYTSRLHSGVPSRFSGSGSGTDYTLTISSLQPEDIATYFCQQGQTLPWTFGQGTKVEIKEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 127 - protein, 125 aa, Artificial Sequence
  Modified or unmodified human sequence
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNAYISYWAYWGQGTLVTVSS

SEQ ID NO: 128 - protein, 454 aa, Artificial Sequence
  Modified or unmodified human sequence
IMNVEQSPQSLHVQEGDSTNFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGDIQMTQSPSSLSASVGDRVTITCRASQDIRNYLNWYQQKPGKAPKLLIYYTSRLHSGVPSRFSGSGSGTDYTLTISSLQPEDIATYFCQQGQTLPWTFGQGTKVEIKEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 129 - protein, 110 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNNDMRFGAGTRLTVKP

SEQ ID NO: 130 - protein, 111 aa, Artificial Sequence
  Modified or unmodified human sequence
GVIQSPRHLVTEMGQEVTLRCKPISGHNSLFWYRETPMQGLELLIYFQNTAVIDDSGMPEDRFSAKMPNASFSTLKIQPSEPRDSAVYFCASSPGATDTQYFGPGTRLTVL

SEQ ID NO: 131 - protein, 470 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 132 - protein, 110 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKP

SEQ ID NO: 133 - protein, 470 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSGGGSGGGGGVIQSPRHEVTEMGQEVTLRCKPISGHNSLFWYRETMMQGLELLIYFQNTAVIDDSGMPEDRFSAKMPNDSFSTLKIQPSEPRDSAVYFCASSPGATDLQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 134 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDKQYFGPGTRLTVL

SEQ ID NO: 135 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNASFSTLKIQPSEPRDSAVYFCASSPGATDKQYFGPGTRLTVL

SEQ ID NO: 136 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDAQYFGPGTRLTVL

SEQ ID NO: 137 - protein, 110 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNLDMRFGAGTRLTVKP

SEQ ID NO: 138 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNDSFSTLKIQPSEPRDSAVYFCASSAGATDKQYFGPGTRLTVL

SEQ ID NO: 139 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGAIDKQYFGPGTRLTVL

SEQ ID NO: 140 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNDSFSTLKIQPSEPRDSAVYFCASSAGSTDAQYFGPGTRLTVL

SEQ ID NO: 141 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSIDAQYFGPGTRLTVL

SEQ ID NO: 142 - protein, 110 aa, Artificial Sequence
  Modified or unmodified human sequence
ILNVEQSPQSLHVQEGDSTKFTCSFPVKEFQDIHWYRKETAKSPEFLFYFGPYGKEKKKGRISATLNTKEGYSYLYITDSQPEDSATYLCALYNNYDMRFGAGTRLTVKP

SEQ ID NO: 143 - protein, 470 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSGGGSGGGGGVIQSPRHEVTEMGQEVTLRCKPISGHNSLFWYRETMMRGLELLIYFQNTAVIDDSGMPEDRFSAKMPNDSFSTLKIQPSEPRDSAVYFCASSPGATDLQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 144 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNASFSTLKIQPSEPRDSAVYFCASSAGATDKQYFGPGTRLTVL

SEQ ID NO: 145 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNASFSTLKIQPSEPRDSAVYFCASSTGATDKQYFGPGTRLTVL

SEQ ID NO: 146 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNASFSTLKIQPSEPRDSAVYFCASSPGAIDKQYFGPGTRLTVL

SEQ ID NO: 147 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNASFSTLKIQPSEPRDSAVYFCASSAGAIDKQYFGPGTRLTVL

SEQ ID NO: 148 - protein, 111 aa, Artificial Sequence
  Modified or unmodified human sequence
GVIQSPRHEVTEMGQEVTLRCKPISGHNSLFWYRETPMQGLELLIYFQNTAVIDDSGMPEDRFSAKMPNASFSTLKIQPSEPRDSAVYFCASSTGAIDKQYFGPGTRLTVL

SEQ ID NO: 149 - protein, 229 aa, Artificial Sequence
  Modified or unmodified human sequence
EPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 150 - protein, 229 aa, Artificial Sequence
  Modified or unmodified human sequence
EPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 151 - protein, 467 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVQSGAEVKKPGASVKVSCKASGYKFTRYVMHWVRQAPGQGLEWMGYINPYNDVTKYAEKFQGRVTLTSDTSTSTAYMELSSLRSEDTAVYYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 152 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDLQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 153 - protein, 479 aa, Artificial Sequence
  Modified or unmodified human sequence
EVQLVQSGAEVKKPGASVKVSCKASGYSFTGYTMNWVRQAPGQGLEWMGLINPYKGVSTYAQKFQDRVTLTVDKSTSTAYMELSSLRSEDTAVYYCARSGYYGDSDWYFDVWGQGTLVTVSSGGGSGGGGKAGVTQTPRYLIKTRGQQVTLSCSPIPGHRAVSWYQQTPGQGLQFLFEYVHGEERNKGNFPGRFSGRQFSNSSSEMNISNLELGDSALYLCASSPWDSPNVQYFGPGTRLTVTEDLKNEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 154 - protein, 463 aa, Artificial Sequence
  Modified or unmodified human sequence
QKEVEQNSGPLSVPEGAIASLNCTYSDRGSQSFFWYRQYSGKSPELIMSIYSNGDKEDGRFTAQLNKASQYVSLLIRDSQPSDSATYLCAAVIDNDQGGILTFGTGTRLTIIPNIQNGGGSGGGGDIQMTQSPSSLSASVGDRVTITCRASQDIRNYLNWYQQKPGKAPKLLIYYTSRLHSGVPSRFSGSGSGTDYTLTISSLQPEDIATYFCQQGQTLPWTFGQGTKVEIKEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 155 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 156 - protein, 467 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNLDMRFGAGTRLTVKPGGGSGGGGEVQLVQSGAEVKKPGASVKVSCKASGYKFTSYVMHWVRQAPGQGLEWMGYINPRNDVTKYAEKFQGRVTLTSDTSTSTAYMELSSLRSEDTAVYYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 157 - protein, 467 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNNDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 158 - protein, 467 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVQSGAEVKKPGASVKVSCKASGYKFTSYVMHWVRQAPGQGLEWMGYINPRNDVTKYAEKFQGRVTLTSDTSTSTAYMELSSLRSEDTAVYYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 159 - protein, 467 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 160 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 161 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSAGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 162 - protein, 454 aa, Artificial Sequence; identical to SEQ ID NO: 160
  Modified or unmodified human sequence

SEQ ID NO: 163 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGAIDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 164 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSAGSTDAQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 165 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSIDAQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 166 - protein, 467 aa, Artificial Sequence
  Modified or unmodified human sequence
ILNVEQSPQSLHVQEGDSTKFTCSFPVKEFQDIHWYRKETAKSPEFLFYFGPYGKEKKKGRISATLNTKEGYSYLYITDSQPEDSATYLCALYNNYDMRFGAGTRLTVKPGGGSGGGGEVQLVQSGAEVKKPGASVKVSCKASGYKFTSYVMHWVRQAPGQGLEWMGYINPRNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 167 - protein, 467 aa, Artificial Sequence; identical to SEQ ID NO: 159
  Modified or unmodified human sequence

SEQ ID NO: 168 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETMMRGLELLIYFQNTAVIDDSGMPEDRFSAKMPNDSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 169 - protein, 467 aa, Artificial Sequence; identical to SEQ ID NO: 103
  Modified or unmodified human sequence

SEQ ID NO: 170 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNASFSTLKIQPSEPRDSAVYFCASSAGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 171 - protein, 467 aa, Artificial Sequence; identical to SEQ ID NO: 155
  Modified or unmodified human sequence

SEQ ID NO: 172 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNASFSTLKIQPSEPRDSAVYFCASSTGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 173 - protein, 467 aa, Artificial Sequence; identical to SEQ ID NO: 157
  Modified or unmodified human sequence

SEQ ID NO: 174 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNASFSTLKIQPSEPRDSAVYFCASSPGAIDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 175 - protein, 472 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGDSYISYWAYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 176 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 177 - protein, 472 aa, Artificial Sequence; identical to SEQ ID NO: 105
  Modified or unmodified human sequence

SEQ ID NO: 178 - protein, 472 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGESYISYWAYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 179 - protein, 472 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 180 - protein, 472 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNAYISYWAYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 181 - protein, 472 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNNDMRFGAGTRLTVKPGGGSGGGGEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 182 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNASFSTLKIQPSEPRDSAVYFCASSAGAIDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 183 - protein, 472 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 184 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNASFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 185 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNASFSTLKIQPSEPRDSAVYFCASSTGAIDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 186 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHEVTEMGQEVTLRCKPISGHNSLFWYRETPMQGLELLIYFQNTAVIDDSGMPEDRFSAKMPNASFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 187 - protein, 9 aa, Artificial Sequence
  Modified or unmodified human sequence
SLAEGRLYL

SEQ ID NO: 188 - protein, 9 aa, Artificial Sequence
  Modified or unmodified human sequence
NLLPKLHIV

SEQ ID NO: 189 - protein, 472 aa, Artificial Sequence; identical to SEQ ID NO: 179
  Modified or unmodified human sequence

SEQ ID NO: 190 - protein, 9 aa, Artificial Sequence
  Modified or unmodified human sequence
AIVDKVPSV

SEQ ID NO: 191 - protein, 472 aa, Artificial Sequence; identical to SEQ ID NO: 181
  Modified or unmodified human sequence

SEQ ID NO: 192 - protein, 9 aa, Artificial Sequence
  Modified or unmodified human sequence
ALATLIHQV

SEQ ID NO: 193 - protein, 472 aa, Artificial Sequence; identical to SEQ ID NO: 183
  Modified or unmodified human sequence

SEQ ID NO: 194 - protein, 9 aa, Artificial Sequence
  Modified or unmodified human sequence
SLDQPTQTV

SEQ ID NO: 195 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNADMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 196 - protein, 9 aa, Artificial Sequence
  Modified or unmodified human sequence
SLFRVITEV

SEQ ID NO: 197 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNDDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 198 - protein, 9 aa, Artificial Sequence
  Modified or unmodified human sequence
RLAVYIDRV

SEQ ID NO: 199 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNEDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 200 - protein, 9 aa, Artificial Sequence
  Modified or unmodified human sequence
PILYRPVAV

SEQ ID NO: 201 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNFDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 202 - protein, 9 aa, Artificial Sequence
  Modified or unmodified human sequence
GLATDVQTV

SEQ ID NO: 203 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNHDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 204 - protein, 9 aa, Artificial Sequence
  Modified or unmodified human sequence
KIYEGQVEV

SEQ ID NO: 205 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNIDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 206 - protein, 9 aa, Artificial Sequence
  Modified or unmodified human sequence
NLCPTRIEV

SEQ ID NO: 207 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNLDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 208 - protein, 9 aa, Artificial Sequence
  Modified or unmodified human sequence
FLLQHQTFL

SEQ ID NO: 209 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNKDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 210 - protein, 9 aa, Artificial Sequence
  Modified or unmodified human sequence
LLAERDLYL

SEQ ID NO: 211 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNQDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 212 - protein, 9 aa, Artificial Sequence
  Modified or unmodified human sequence
ELDVRITAL

SEQ ID NO: 213 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNRDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 214 - protein, 8 aa, Artificial Sequence
  Modified or unmodified human sequence
GGGSGGGG

SEQ ID NO: 215 - protein, 467 aa, Artificial Sequence
  Modified or unmodified human sequence
ILNVEQSPQSLHVQEGDSTNFTCSFPVKEFQDLHWYRKETAKSPEFLFYFGPYGKEKKKGRISATLNTKEGYSYLYITDSQPEDSATYLCALYNNVDMRFGAGTRLTVKPGGGSGGGGEVQLVQSGAEVKKPGASVKVSCKASGYKFTSYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 216 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNESFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 217 - protein, 467 aa, Artificial Sequence; identical to SEQ ID NO: 155
  Modified or unmodified human sequence

SEQ ID NO: 218 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNRSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 219 - protein, 9 aa, Artificial Sequence
  Modified or unmodified human sequence
ALYNNADMR

SEQ ID NO: 220 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNKSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 221 - protein, 9 aa, Artificial Sequence
  Modified or unmodified human sequence
ALYNNDDMR

SEQ ID NO: 222 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNQSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 223 - protein, 9 aa, Artificial Sequence
  Modified or unmodified human sequence
ALYNNEDMR

SEQ ID NO: 224 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNNSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 225 - protein, 9 aa, Artificial Sequence
  Modified or unmodified human sequence
ALYNNFDMR

SEQ ID NO: 226 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNYSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 227 - protein, 9 aa, Artificial Sequence
  Modified or unmodified human sequence
ALYNNHDMR

SEQ ID NO: 228 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNSSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 229 - protein, 9 aa, Artificial Sequence
  Modified or unmodified human sequence
ALYNNIDMR

SEQ ID NO: 230 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDRQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 231 - protein, 9 aa, Artificial Sequence
  Modified or unmodified human sequence
ALYNNKDMR

SEQ ID NO: 232 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDHQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 233 - protein, 9 aa, Artificial Sequence
  Modified or unmodified human sequence
ALYNNQDMR

SEQ ID NO: 234 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDEQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 235 - protein, 9 aa, Artificial Sequence
  Modified or unmodified human sequence
ALYNNRDMR

SEQ ID NO: 236 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDAQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 237 - protein, 9 aa, Artificial Sequence
  Modified or unmodified human sequence
ALYNNVDMR

SEQ ID NO: 238 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDQQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 239 - protein, 11 aa, Artificial Sequence
  Modified or unmodified human sequence
ASSPGATDLQY

SEQ ID NO: 240 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDNQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 241 - protein, 11 aa, Artificial Sequence
  Modified or unmodified human sequence
ASSPGATDRQY

SEQ ID NO: 242 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDFQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 243 - protein, 11 aa, Artificial Sequence
  Modified or unmodified human sequence
ASSPGATDHQY

SEQ ID NO: 244 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDYQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 245 - protein, 11 aa, Artificial Sequence
  Modified or unmodified human sequence
ASSPGATDEQY

SEQ ID NO: 246 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDIQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 247 - protein, 11 aa, Artificial Sequence
  Modified or unmodified human sequence
ASSPGATDAQY

SEQ ID NO: 248 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGATDVQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 249 - protein, 11 aa, Artificial Sequence
  Modified or unmodified human sequence
ASSPGATDQQY

SEQ ID NO: 250 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDRQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 251 - protein, 11 aa, Artificial Sequence
  Modified or unmodified human sequence
ASSPGATDNQY

SEQ ID NO: 252 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDHQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 253 - protein, 11 aa, Artificial Sequence
  Modified or unmodified human sequence
ASSPGATDFQY

SEQ ID NO: 254 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDEQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 255 - protein, 11 aa, Artificial Sequence
  Modified or unmodified human sequence
ASSPGATDYQY

SEQ ID NO: 256 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDAQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 257 - protein, 11 aa, Artificial Sequence
  Modified or unmodified human sequence
ASSPGATDIQY

SEQ ID NO: 258 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDQQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 259 - protein, 11 aa, Artificial Sequence
  Modified or unmodified human sequence
ASSPGATDVQY

SEQ ID NO: 260 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDNQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 261 - protein, 11 aa, Artificial Sequence
  Modified or unmodified human sequence
ASSPGSTDRQY

SEQ ID NO: 262 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDFQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 263 - protein, 11 aa, Artificial Sequence
  Modified or unmodified human sequence
ASSPGSTDHQY

SEQ ID NO: 264 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDYQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 265 - protein, 11 aa, Artificial Sequence
  Modified or unmodified human sequence
ASSPGSTDEQY

SEQ ID NO: 266 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDIQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 267 - protein, 11 aa, Artificial Sequence
  Modified or unmodified human sequence
ASSPGSTDQQY

SEQ ID NO: 268 - protein, 454 aa, Artificial Sequence
  Modified or unmodified human sequence
QIQMTQSPSSLSASVGDRVTITCSATSSVSYMHWYQQKPGKAPKRWIYDTSKLASGVPSRFSGSGSGTDYTLTISSLQPEDAATYYCQQWSSNPLTFGGGTKVEIKGGGSGGGGGVIQSPRHEVTEMGQEVTLRCKPISGHNSLFWYRETPMQGLELLIYFQNTAVIDDSGMPEDRFSAKMPNDSFSTLKIQPSEPRDSAVYFCASSPGSTDVQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 269 - protein, 11 aa, Artificial Sequence
  Modified or unmodified human sequence
ASSPGSTDNQY

SEQ ID NO: 270 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHEVTEMGQEVTLRCKPISGHNSLFWYRETPMQGLELLIYFQNTAVIDDSGMPEDRFSAKMPNESFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 271 - protein, 11 aa, Artificial Sequence
  Modified or unmodified human sequence
ASSPGSTDFQY

SEQ ID NO: 272 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHEVTEMGQEVTLRCKPISGHNSLFWYRETPMQGLELLIYFQNTAVIDDSGMPEDRFSAKMPNRSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 273 - protein, 11 aa, Artificial Sequence
  Modified or unmodified human sequence
ASSPGSTDYQY

SEQ ID NO: 274 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHEVTEMGQEVTLRCKPISGHNSLFWYRETPMQGLELLIYFQNTAVIDDSGMPEDRFSAKMPNKSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 275 - protein, 11 aa, Artificial Sequence
  Modified or unmodified human sequence
ASSPGSTDIQY

SEQ ID NO: 276 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHEVTEMGQEVTLRCKPISGHNSLFWYRETPMQGLELLIYFQNTAVIDDSGMPEDRFSAKMPNQSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 277 - protein, 11 aa, Artificial Sequence
  Modified or unmodified human sequence
ASSPGSTDVQY

SEQ ID NO: 278 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHEVTEMGQEVTLRCKPISGHNSLFWYRETPMQGLELLIYFQNTAVIDDSGMPEDRFSAKMPNNSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 279 - protein, 11 aa, Artificial Sequence
  Modified or unmodified human sequence
ASSSGATDVQY

SEQ ID NO: 280 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHEVTEMGQEVTLRCKPISGHNSLFWYRETPMQGLELLIYFQNTAVIDDSGMPEDRFSAKMPNYSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 281 - protein, 11 aa, Artificial Sequence
  Modified or unmodified human sequence
ASSAGATDKQY

SEQ ID NO: 282 - protein, 457 aa, Artificial Sequence
  Modified or unmodified human sequence
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLGGGSGGGGGVIQSPRHEVTEMGQEVTLRCKPISGHNSLFWYRETPMQGLELLIYFQNTAVIDDSGMPEDRFSAKMPNSSFSTLKIQPSEPRDSAVYFCASSPGATDKQYFGPGTRLTVLEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 283 - protein, 11 aa, Artificial Sequence
  Modified or unmodified human sequence
ASSPGAIDKQY

SEQ ID NO: 284 - protein, 454 aa, Artificial Sequence; identical to SEQ ID NO: 256
  Modified or unmodified human sequence

SEQ ID NO: 285 - protein, 467 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVQSGAEVKKPGASVKVSCKASGYKFTRYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 286 - protein, 5 aa, Artificial Sequence
  Modified or unmodified human sequence
GGGGS

SEQ ID NO: 287 - protein, 5 aa, Artificial Sequence
  Modified or unmodified human sequence
GGGAS

SEQ ID NO: 288 - protein, 10 aa, Artificial Sequence
  Modified or unmodified human sequence
EQKLISEEDL

SEQ ID NO: 289 - protein, 8 aa, Artificial Sequence
  Modified or unmodified human sequence
AAAGGSGG

SEQ ID NO: 290 - protein, 4 aa, Artificial Sequence
  Modified or unmodified human sequence
GGGS

SEQ ID NO: 291 - protein, 467 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNYDMRFGAGTRLTVKPGGGSGGGGEVQLVQSGAEVKKPGASVKVSCKASGYKFTSYVMHWVRQAPGQGLEWMGYINPRNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 292 - protein, 11 aa, Artificial Sequence
  Modified or unmodified human sequence
ASSAGSTDAQY

SEQ ID NO: 293 - protein, 11 aa, Artificial Sequence
  Modified or unmodified human sequence
ASSRGSTDAQY

SEQ ID NO: 294 - protein, 11 aa, Artificial Sequence
  Modified or unmodified human sequence
ASSPGSIDAQY

SEQ ID NO: 295 - protein, 472 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNLDMRFGAGTRLTVKPGGGSGGGGEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 296 - protein, 457 aa, Artificial Sequence; identical to SEQ ID NO: 176
  Modified or unmodified human sequence

SEQ ID NO: 297 - protein, 11 aa, Artificial Sequence
  Modified or unmodified human sequence
ASSTGATDKQY

SEQ ID NO: 298 - protein, 11 aa, Artificial Sequence
  Modified or unmodified human sequence
ASSAGAIDKQY

SEQ ID NO: 299 - protein, 467 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNLDMRFGAGTRLTVKPGGGSGGGGEVQLVQSGAEVKKPGASVKVSCKASGYKFTRYVMHWVRQAPGQGLEWMGYINPYNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 300 - protein, 454 aa, Artificial Sequence; identical to SEQ ID NO: 184
  Modified or unmodified human sequence

SEQ ID NO: 301 - protein, 11 aa, Artificial Sequence
  Modified or unmodified human sequence
ASSTGAIDKQY

SEQ ID NO: 302 - protein, 11 aa, Artificial Sequence
  Modified or unmodified human sequence
ASSSGATDTQY

SEQ ID NO: 303 - protein, 467 aa, Artificial Sequence
  Modified or unmodified human sequence
ILNVEQSPQSLHVQEGDSTKFTCSFPVKEFQDLHWYRKETAKSPEFLFYFGPYGKEKKKGRISATLNTKEGYSYLYITDSQPEDSATYLCALYNNLDMRFGAGTRLTVKPGGGSGGGGEVQLVQSGAEVKKPGASVKVSCKASGYKFTSYVMHWVRQAPGQGLEWMGYINPRNDVTKYAEKFQGRVTLTSDTSTSTAYMELSSLRSEDTAVHYCARGSYYDYEGFVYWGQGTLVTVSSEPKSSDKTHTCPPCPAPPVAGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPASIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 304 - protein, 9 aa, Artificial Sequence
  Modified or unmodified human sequence
HLLPEVFTL

SEQ ID NO: 305 - protein, 9 aa, Artificial Sequence
  Modified or unmodified human sequence
DVLNPLITA

SEQ ID NO: 306 - protein, 9 aa, Artificial Sequence
  Modified or unmodified human sequence
LTLGHLMGV

SEQ ID NO: 307 - protein, 9 aa, Artificial Sequence
  Modified or unmodified human sequence
FLLSEPVAL

SEQ ID NO: 308 - protein, 9 aa, Artificial Sequence
  Modified or unmodified human sequence
LLTPAVQDL

SEQ ID NO: 309 - protein, 9 aa, Artificial Sequence
  Modified or unmodified human sequence
YLQASYTYL

SEQ ID NO: 310 - protein, 9 aa, Artificial Sequence
  Modified or unmodified human sequence
FLDTIKSNL

SEQ ID NO: 311 - protein, 9 aa, Artificial Sequence
  Modified or unmodified human sequence
SLLVHNVSV

SEQ ID NO: 312 - protein, 9 aa, Artificial Sequence
  Modified or unmodified human sequence
TLQEFLKLA

SEQ ID NO: 313 - protein, 9 aa, Artificial Sequence
  Modified or unmodified human sequence
FLITQLKML

SEQ ID NO: 314 - protein, 9 aa, Artificial Sequence
  Modified or unmodified human sequence
VLDSVKLEA

SEQ ID NO: 315 - protein, 9 aa, Artificial Sequence
  Modified or unmodified human sequence
ILQTFKTVA

SEQ ID NO: 316 - protein, 9 aa, Artificial Sequence
  Modified or unmodified human sequence
ILASELSRL

SEQ ID NO: 317 - protein, 9 aa, Artificial Sequence
  Modified or unmodified human sequence
SLNLRETNL

SEQ ID NO: 318 - protein, 9 aa, Artificial Sequence
  Modified or unmodified human sequence
ALLQHLIGL

SEQ ID NO: 319 - protein, 9 aa, Artificial Sequence
  Modified or unmodified human sequence
SLAQHLIGL

SEQ ID NO: 320 - protein, 9 aa, Artificial Sequence
  Modified or unmodified human sequence
SLLAHLIGL

SEQ ID NO: 321 - protein, 9 aa, Artificial Sequence
  Modified or unmodified human sequence
SLLQALIGL

SEQ ID NO: 322 - protein, 9 aa, Artificial Sequence
  Modified or unmodified human sequence
SLLQHAIGL

SEQ ID NO: 323 - protein, 9 aa, Artificial Sequence
  Modified or unmodified human sequence
SLLQHLAGL

SEQ ID NO: 324 - protein, 9 aa, Artificial Sequence
  Modified or unmodified human sequence
SLLQHLIAL

SEQ ID NO: 325 - protein, 369 aa, Artificial Sequence
  Modified or unmodified human sequence
MQLLRCFSIFSVIASVLAQELTTICEQIPSPTLESTPYSLSTTTILANGKAMQGVFEYYKSVTFVSNCGSHPSTTSKGSPINTQYVFGGGGSDYKDDDDKGGGASILNVEQSPQSLHVQEGDSTNFTCSFPSSNFYALHWYRWETAKSPEALFVMTLNGDEKKKGRISATLNTKEGYSYLYIKGSQPEDSATYLCALYNNNDMRFGAGTRLTVKPGGGGSGGGGSGGGGSGGGGSGGGGSGVIQSPRHEVTEMGQEVTLRCKPISGHNSLFWYRQTMMRGLELLIYFNNNVPIDDSGMPEDRFSAKMPNASFSTLKIQPSEPRDSAVYFCASSPGSTDTQYFGPGTRLTVLAAAGGSGGEQKLISEEDL

SEQ ID NO: 326 - protein, 9 aa, Artificial Sequence
  Modified or unmodified human sequence
  X1 (6)..(6): X1 is L or Y
ALYNNXDMR

SEQ ID NO: 327 - protein, 11 aa, Artificial Sequence
  Modified or unmodified human sequence
  X1 (4)..(4): X1 is P, A or T
  X2 (6)..(6): X2 is A or S
  X3 (7)..(7): X3 is T or I
  X4 (9)..(9): X4 is K or A
ASSXGXXDXQY

SEQ ID NO: 328 - protein, 509 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 329 - protein, 232 aa, Artificial Sequence
  Modified or unmodified human sequence
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 330 - protein, 21 aa, Artificial Sequence
  Modified or unmodified human sequence
EPKSCDKTHTCPPCPAPELLG

SEQ ID NO: 331 - protein, 19 aa, Artificial Sequence
  Modified or unmodified human sequence
ERKCCVECPPCPAPPVAGP

SEQ ID NO: 332 - protein, 53 aa, Artificial Sequence
  Modified or unmodified human sequence
ELKTPLGDTTHTCPRCPEPKSCDTPPPCPRCPEPKSCDTPPPCPRCPAPELLG

SEQ ID NO: 333 - protein, 18 aa, Artificial Sequence
  Modified or unmodified human sequence
ESKYGPPCPSCPAPEFLG

SEQ ID NO: 334 - protein, 6 aa, Artificial Sequence
  Modified or unmodified human sequence
  X1 (1)..(1): X1 is V, T, N, I or S, preferably V; T or N, most preferably V,
  X2 (2)..(2): X2 is K, R, S or A, more preferably K or R, most preferably K
  X3 (6)..(6): X3 is D or N, preferably D
XXEFQX

SEQ ID NO: 335 - protein, 7 aa, Artificial Sequence
  Modified or unmodified human sequence
  X1 (6)..(6): X1 is K, R, T or V, preferably K or R, most preferably K
FGPYGXE

SEQ ID NO: 336 - protein, 9 aa, Artificial Sequence
  Modified or unmodified human sequence
  X1 (6)..(6): X1 is L, Y, H, Q, A, I, K, R, V, D, E, F or N, preferably L, Y, H, Q, A, I, K or R, more preferably L, Y, H, Q or A, most preferably L or Y
ALYNNXDMR

SEQ ID NO: 337 - protein, 6 aa, Artificial Sequence
  Modified or unmodified human sequence
  X1 (1)..(1): X1 is F, Y, M or L, preferably F or Y, most preferably F
  X2 (2)..(2): X2 is Q or N, preferably Q (if X2 is N, then X3 is also N)
  X3 (3)..(3): X3 is N or S, preferably N
  X4 (4)..(4): X4 is T, S, or E, preferably T or S, most preferably T (if X4 is S, then X2 is Q)
  X5 (5)..(5): X5 is A or T, preferably A
  X6 (6)..(6): X6 is V, I, L or T, preferably V or I, most preferably V
XXXXXX

SEQ ID NO: 338 - protein, 11 aa, Artificial Sequence
  Modified or unmodified human sequence
  X1 (4)..(4): X1 is P, R, A, T, or S, preferably P, T or A, most preferably P
  X2 (6)..(6): X2 is A or S, preferably A
  X3 (7)..(7): X3 is T or I, preferably T
  X4 (9)..(9): X4 is K, A, L, I, V, R, Q, N, Y, T, H, E or F, preferably K, A, L, I, V, R, Q N, or Y, more preferably K, A, L, I, V or R, most preferably K or A
ASSXGXXDXQY

SEQ ID NO: 339 - protein, 6 aa, Artificial Sequence
  Modified or unmodified human sequence
DRGSQS

SEQ ID NO: 340 - protein, 6 aa, Artificial Sequence
  Modified or unmodified human sequence
IYSNGD

SEQ ID NO: 341 - protein, 13 aa, Artificial Sequence
  Modified or unmodified human sequence
AAVIDNDQGGILT

SEQ ID NO: 342 - protein, 5 aa, Artificial Sequence
  Modified or unmodified human sequence
PGHRA

SEQ ID NO: 343 - protein, 6 aa, Artificial Sequence
  Modified or unmodified human sequence
YVHGEE

SEQ ID NO: 344 - protein, 12 aa, Artificial Sequence
  Modified or unmodified human sequence
ASSPWDSPNVQY

SEQ ID NO: 345 - protein, 26 aa, Artificial Sequence
  Modified or unmodified human sequence
ILNVEQSPQSLHVQEGDSTKFTCSFP

SEQ ID NO: 346 - protein, 26 aa, Artificial Sequence
  Modified or unmodified human sequence
ILNVEQSPQSLHVQEGDSTNFTCSFP

SEQ ID NO: 347 - protein, 17 aa, Artificial Sequence
  Modified or unmodified human sequence
LHWYRKETAKSPEFLFY

SEQ ID NO: 348 - protein, 17 aa, Artificial Sequence
  Modified or unmodified human sequence
IHWYRKETAKSPEFLFY

SEQ ID NO: 349 - protein, 34 aa, Artificial Sequence
  Modified or unmodified human sequence
KKKGRISATLNTKEGYSYLYITDSQPEDSATYLC

SEQ ID NO: 350 - protein, 11 aa, Artificial Sequence
  Modified or unmodified human sequence
FGAGTRLTVKP

SEQ ID NO: 351 - protein, 24 aa, Artificial Sequence
  Modified or unmodified human sequence
GVIQSPRHEVTEMGQEVTLRCKPI

SEQ ID NO: 352 - protein, 24 aa, Artificial Sequence
  Modified or unmodified human sequence
GVIQSPRHLVTEMGQEVTLRCKPI

SEQ ID NO: 353 - protein, 17 aa, Artificial Sequence
  Modified or unmodified human sequence
LFWYRETPMQGLELLIY

SEQ ID NO: 354 - protein, 38 aa, Artificial Sequence
  Modified or unmodified human sequence
IDDSGMPEDRFSAKMPNDSFSTLKIQPSEPRDSAVYFC

SEQ ID NO: 355 - protein, 38 aa, Artificial Sequence
  Modified or unmodified human sequence
IDDSGMPEDRFSAKMPNASFSTLKIQPSEPRDSAVYFC

SEQ ID NO: 356 - protein, 10 aa, Artificial Sequence
  Modified or unmodified human sequence
FGPGTRLTVL

SEQ ID NO: 357 - protein, 258 aa, Artificial Sequence
  Modified or unmodified human sequence
QKEVEQNSGPLSVPEGAIASLNCTYSDRGSQSFFWYRQYSGKSPELIMSIYSNGDKEDGRFTAQLNKASQYVSLLIRDSQPSDSATYLCAAVIDNDQGGILTFGTGTRLTIIPNIQNGGGGSGGGGSGGGGSGGGGSGGGGSGVTQTPRYLIKTRGQQVTLSCSPIPGHRAVSWYQQTPGQGLQFLFEYVHGEERNKGNFPGRFSGRQFSNSSSEMNISNLELGDSALYLCASSPWDSPNVQYFGPGTRLTVTEDLKN

SEQ ID NO: 358 - protein, 8 aa, Artificial Sequence
  Modified or unmodified human sequence
GGGGSAAA

SEQ ID NO: 359 - protein, 6 aa, Artificial Sequence
  Modified or unmodified human sequence
  X1 (1)..(1): X1 is F, Y, M or L, preferably F or Y, most preferably F
  X3 (3)..(3): X3 is N or S, preferably N
  X5 (5)..(5): X5 is A or T, preferably A
  X6 (6)..(6): X6 is V, I, L or T, preferably V or I, most preferably V
XQXTXX

SEQ ID NO: 360 - protein, 119 aa, Artificial Sequence
  Modified or unmodified human sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPSPAPPVAG

SEQ ID NO: 361 - protein, 141 aa, Artificial Sequence
  Modified or unmodified human sequence
NIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 362 - protein, 179 aa, Artificial Sequence
  Modified or unmodified human sequence
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 363 - protein, 11 aa, Artificial Sequence
  Modified or unmodified human sequence
  X2 (6)..(6): X2 is A or S, preferably A
  X4 (9)..(9): X4 is T, K or A, preferably K or A, more preferably K
ASSPGXTDXQY

SEQ ID NO: 364 - protein, 11 aa, Artificial Sequence
  Modified or unmodified human sequence
  X2 (6)..(6): X2 is A or S, preferably A
  X3 (7)..(7): X3 is T or I
  X4 (9)..(9): X4 is T, K or A, preferably K or A, more preferably K
ASSPGXXDXQY

SEQ ID NO: 365 - protein, 11 aa, Artificial Sequence
  Modified or unmodified human sequence
  X3 (7)..(7): X3 is T or I, preferably I
  X4 (9)..(9): X4 is K or A, preferably K
ASSPGAXDXQY

SEQ ID NO: 366 - protein, 120 aa, Artificial Sequence
  Modified or unmodified human sequence
EVQLVQSGAEVKKPGASVKVSCKASGYKFTSYVMHWVRQAPGQGLEWMGYINPYNDVTKYAEKFQGRVTLTSDTSTSTAYMELSSLRSEDTAVYYCARGSYYDYEGFVYWGQGTLVTVSS

SEQ ID NO: 367 - protein, 120 aa, Artificial Sequence
  Modified or unmodified human sequence
EVQLVQSGAEVKKPGASVKVSCKASGYKFTSYVMHWVRQAPGQGLEWMGYINPYKDVTKYAEKFQGRVTLTSDTSTSTAYMELSSLRSEDTAVHYCARGSYYDYEGFVYWGQGTLVTVSS

SEQ ID NO: 368 - protein, 120 aa, Artificial Sequence
  Modified or unmodified human sequence
EVQLVQSGAEVKKPGASVKVSCKASGYKFTSYVMHWVRQAPGQGLEWMGYINPYKDVTKYAEKFQGRVTLTSDTSTSTAYMELSSLRSEDTAVYYCARGSYYDYEGFVYWGQGTLVTVSS

SEQ ID NO: 369 - protein, 120 aa, Artificial Sequence
  Modified or unmodified human sequence
EVQLVQSGAEVKKPGASVKVSCKASGYKFTSYVMHWVRQAPGQGLEWMGYINPYRDVTKYAEKFQGRVTLTSDTSTSTAYMELSSLRSEDTAVHYCARGSYYDYEGFVYWGQGTLVTVSS

SEQ ID NO: 370 - protein, 120 aa, Artificial Sequence
  Modified or unmodified human sequence
EVQLVQSGAEVKKPGASVKVSCKASGYKFTSYVMHWVRQAPGQGLEWMGYINPYRDVTKYAEKFQGRVTLTSDTSTSTAYMELSSLRSEDTAVYYCARGSYYDYEGFVYWGQGTLVTVSS

SEQ ID NO: 371 - protein, 120 aa, Artificial Sequence
  Modified or unmodified human sequence
EVQLVQSGAEVKKPGASVKVSCKASGYKFTHYVMHWVRQAPGQGLEWMGYINPYNDVTKYAEKFQGRVTLTSDTSTSTAYMELSSLRSEDTAVHYCARGSYYDYEGFVYWGQGTLVTVSS

SEQ ID NO: 372 - protein, 120 aa, Artificial Sequence
  Modified or unmodified human sequence
EVQLVQSGAEVKKPGASVKVSCKASGYKFTKYVMHWVRQAPGQGLEWMGYINPYNDVTKYAEKFQGRVTLTSDTSTSTAYMELSSLRSEDTAVHYCARGSYYDYEGFVYWGQGTLVTVSS

SEQ ID NO: 373 - protein, 120 aa, Artificial Sequence
  Modified or unmodified human sequence
EVQLVQSGAEVKKPGASVKVSCKASGYKFKSYVMHWVRQAPGQGLEWMGYINPYNDVTKYAEKFQGRVTLTSDTSTSTAYMELSSLRSEDTAVHYCARGSYYDYEGFVYWGQGTLVTVSS

SEQ ID NO: 374 - protein, 120 aa, Artificial Sequence
  Modified or unmodified human sequence
EVQLVQSGAEVKKPGASVKVSCKASGYKFRSYVMHWVRQAPGQGLEWMGYINPYNDVTKYAEKFQGRVTLTSDTSTSTAYMELSSLRSEDTAVHYCARGSYYDYEGFVYWGQGTLVTVSS

SEQ ID NO: 375 - protein, 120 aa, Artificial Sequence
  Modified or unmodified human sequence
EVQLVQSGAEVKKPGASVKVSCKASGYKFTSYVMHWVRQAPGQGLEWMGYINPHNDVTKYAEKFQGRVTLTSDTSTSTAYMELSSLRSEDTAVHYCARGSYYDYEGFVYWGQGTLVTVSS

SEQ ID NO: 376 - protein, 120 aa, Artificial Sequence
  Modified or unmodified human sequence
EVQLVQSGAEVKKPGASVKVSCKASGYKFTSYVMHWVRQAPGQGLEWMGYINPKNDVTKYAEKFQGRVTLTSDTSTSTAYMELSSLRSEDTAVHYCARGSYYDYEGFVYWGQGTLVTVSS

SEQ ID NO: 377 - protein, 106 aa, Artificial Sequence
  Modified or unmodified human sequence
QIQMTQSPSSLSASVGDRVTITCSATSSVKYMHWYQQKPGKAPKRWIYDTSKLASGVPSRFSGSGSGTDYTLTISSLQPEDAATYYCQQWSSNPLTFGGGTKVEIK

SEQ ID NO: 378 - protein, 106 aa, Artificial Sequence
  Modified or unmodified human sequence
QIQMTQSPSSLSASVGDRVTITCSATSSVRYMHWYQQKPGKAPKRWIYDTSKLASGVPSRFSGSGSGTDYTLTISSLQPEDAATYYCQQWSSNPLTFGGGTKVEIK

SEQ ID NO: 379 - protein, 106 aa, Artificial Sequence
  Modified or unmodified human sequence
QIQMTQSPSSLSASVGDRVTITCSATSSVSYMHWYQQKPGKAPKRWIYDTSKLAKGVPSRFSGSGSGTDYTLTISSLQPEDAATYYCQQWSSNPLTFGGGTKVEIK

SEQ ID NO: 380 - protein, 106 aa, Artificial Sequence
  Modified or unmodified human sequence
QIQMTQSPSSLSASVGDRVTITCSATSSVSYMHWYQQKPGKAPKRWIYDTSKLARGVPSRFSGSGSGTDYTLTISSLQPEDAATYYCQQWSSNPLTFGGGTKVEIK

SEQ ID NO: 381 - protein, 5 aa, Artificial Sequence
  Modified or unmodified human sequence
SYVMH

SEQ ID NO: 382 - protein, 17 aa, Artificial Sequence
  Modified or unmodified human sequence
  X1 (12)..(12): X1 is A or N
  X2 (13)..(13): X2 is E or Q
  X3 (16)..(16): X3 is Q or K
YINPYNDVTKYXXKFXG

SEQ ID NO: 383 - protein, 10 aa, Artificial Sequence
  Modified or unmodified human sequence
SATSSVSYMH

SEQ ID NO: 384 - protein, 7 aa, Artificial Sequence
  Modified or unmodified human sequence
DTSKLAS

---

The invention claimed is:

1. An antigen binding protein specifically binding to a PRAME antigenic peptide that comprises the amino acid sequence SLLQHLIGL of SEQ ID NO: 50 and is in a complex with a major histocompatibility complex (MHC) protein, the antigen binding protein comprising (a) a first polypeptide comprising a variable domain (VA) comprising complementarity determining regions (CDRs) CDRa1, CDRa2 and CDRa3, wherein the CDRa1 comprises the amino acid sequence VKEFQD (SEQ ID NO: 16), and the CDRa3 comprises the amino acid sequence of ALYNNYDMR (SEQ ID NO: 34), and the CDRa2 comprises the amino acid sequence FGPYGKE (SEQ ID NO: 32), and (b) a second polypeptide comprising a variable domain (VB) comprising CDRb1, CDRb2 and CDRb3, wherein the CDRb1 comprises the amino acid sequence SGHNS (SEQ ID NO: 10), and the CDRb3 comprises the amino acid sequence ASSP-GATDKQY (SEQ ID NO: 48), and the CDRb2 comprises the amino acid sequence FQN-TAV (SEQ ID NO: 36).

2. The antigen binding protein of claim 1, wherein said antigen binding protein specifically binds to a functional epitope consisting of SEQ ID NO: 50.

3. The antigen binding protein of claim 1, wherein said antigen binding protein does not significantly bind to at least 1, at least 2, at least 3, at least 4, at least 5, at least 10, at least 20 or all similar peptides selected from the group consisting of TMED9-001 (SEQ ID NO: 51), CAT-001 (SEQ ID NO: 52), DDX60L-001 (SEQ ID NO: 53), LRRC70-001 (SEQ ID NO: 54), PTPLB-001 (SEQ ID NO: 55), HDAC5-001 (SEQ ID NO: 56), VPS13B-002 (SEQ ID NO: 57), ZNF318-001 (SEQ ID NO: 58), CCDC51-001 (SEQ ID NO: 59), IFT17-003 (SEQ ID NO: 60), DIAPH1-004 (SEQ ID NO: 62), FADS2-001 (SEQ ID NO: 63), FRYL-003 (SEQ ID NO: 64), GIMAP8-001 (SEQ ID NO: 65), HSF1-001 (SEQ ID NO: 66), KNT-001 (SEQ ID NO: 67), MAU-001 (SEQ ID NO: 68), MCM4-001 (SEQ ID NO: 69), MPPE1-001 (SEQ ID NO: 71), MYO1B-002 (SEQ ID NO: 72), PRR12-001 (SEQ ID NO: 73), PTRF-003 (SEQ ID NO: 74), RASGRP1-001 (SEQ ID NO: 75), SMARCD1-001 (SEQ ID NO: 76), TGM2-001 (SEQ ID NO: 77), VAV1-001 (SEQ ID NO: 78), VIM-009 (SEQ ID NO: 317), FARSA-001 (SEQ ID NO: 306), ALOX15B-003 (SEQ ID NO: 304), FAM114A2-002 (SEQ ID NO: 305), GPR56-002 (SEQ ID NO: 307), IGHD-002 (SEQ ID NO: 308), NOMAP-3-0972 (SEQ ID NO: 309), NOMAP-3-1265 (SEQ ID NO: 310), NOMAP-3-1408 (SEQ ID NO: 311), NOMAP-3-1587 (SEQ ID NO: 312), NOMAP-3-1768 (SEQ ID NO: 313), NOMAP-5-0765 (SEQ ID NO: 314), PDCD10-004 (SEQ ID NO: 315), TSN-001 (SEQ ID NO: 316), ARMC9-002 (SEQ ID NO: 187), CLI-001 (SEQ ID NO: 188), COPG1-001 (SEQ ID NO: 190), COPS7A-001 (SEQ ID NO: 192), EIF-009 (SEQ ID NO: 194), EXT2-006 (SEQ ID NO: 196), LMNA-001 (SEQ ID NO: 198), PKM-005 (SEQ ID NO: 200), PSMB3-002 (SEQ ID NO: 202), RPL-007 (SEQ ID NO: 204), SPATS2L-003 (SEQ ID NO: 206), SYNE1-002 (SEQ ID NO: 208), TGM2-002 (SEQ ID NO: 210) and TPR-004 (SEQ ID NO: 212), in a complex with a MHC protein, optionally said antigen binding protein does not significantly bind to IFT17-003 (SEQ ID NO: 60) in a complex with a MHC protein.

4. The antigen binding protein of claim 1, wherein the antigen binding protein is multispecific.

5. The antigen binding protein of claim 1, wherein
the first and the second polypeptide are comprised in a single polypeptide chain or two polypeptide chains, optionally wherein VA is comprised in a first polypeptide chain and VB is comprised in a second polypeptide chain; and/or
the variable domain VA is a Vα or Vγ domain and the variable domain VB is a Vβ or Vδ domain.

6. The antigen binding protein of claim 1, wherein
the VA further comprises one or more framework regions, optionally all framework regions, selected from the group consisting of FR1-a, FR2-a, FR3-a and FR4-a, wherein
FR1-a comprises the amino acid sequence of SEQ ID NO: 345 or SEQ ID NO: 346, or an amino acid sequence at least 90% identical to SEQ ID NO: 345, optionally comprising K or N, optionally K, at position 20 and/or L or M, optionally L, at position 2;

FR2-a comprises the amino acid sequence of SEQ ID NO: 347 or SEQ ID NO: 348, or an amino acid sequence at least 90% identical to SEQ ID NO: 347, optionally comprising L, I or M, optionally L or I, at position 39, A or D, optionally A, at position 47, K or W, optionally K, at position 44, F or A, optionally F, at position 52 and/or Y or V, preferably Y, at position 55;

FR3-a comprises the amino acid sequence of SEQ ID NO: 349 or an amino acid sequence at least 90% identical to SEQ ID NO: 349, optionally comprising T or K, optionally T, at position 92 and/or D or G, optionally D, at position 93;

FR4-a comprises the amino acid sequence of SEQ ID NO: 350 or an amino acid sequence at least 90% identical to SEQ ID NO: 350; and the VB further comprises one or more framework regions, optionally all framework regions, selected from the group consisting of FR1-b, FR2-b, FR3-b and FR4-b, wherein FR1-b comprises the amino acid sequence of SEQ ID NO: 351 or SEQ ID NO: 352 or an amino acid sequence at least 90% identical to SEQ ID NO: 351, optionally comprising H or N, optionally H, at position 10, E, L or K, preferably E, at position 11 and/or R or H, at position 22;

FR2-b comprises the amino acid sequence of SEQ ID NO: 353 or an amino acid sequence at least 90% identical to SEQ ID NO: 353, optionally comprising R or K, optionally R, at position 43, E or Q, optionally E, at position 44, M or P, optionally P, at position 46, and/or R or Q, optionally Q, at position 48;

FR3-b comprises the amino acid sequence of SEQ ID NO: 354 or SEQ ID NO: 355 or an amino acid sequence at least 90% identical to SEQ ID NO: 354, optionally comprising D, A, E, R, K Q, Nor S, optionally D, A, E, Q, N or S, optionally D or A, optionally D, at position 84; and FR4-b comprises the amino acid sequence of SEQ ID NO: 356 or an amino acid sequence at least 90% identical to SEQ ID NO: 356.

7. The antigen binding protein of claim 1, wherein
the VA comprises the amino acid sequence of SEQ ID NO: 132 or an amino acid sequence at least 85% identical to SEQ ID NO: 132; and
the VB comprises the amino acid sequence of SEQ ID NO: 135 or an amino acid sequence at least 85% identical to SEQ ID NO: 135.

8. The antigen binding protein of claim 1, further comprising an antibody light chain variable domain (VL) and an antibody heavy chain variable domain (VH), wherein optionally wherein the VL and the VH bind to an α/β TCR/CD3 complex.

9. The antigen binding protein of claim 8, wherein the antigen binding protein comprises a first and a second polypeptide chain, and wherein
the first polypeptide chain is represented by a formula [Ia]:

V1-L1-D1-L2-V2-L3-D2                    [Ia], and the second polypeptide chain is represented by a formula [IIa]

V3-L4-D3-L5-V4-L6-D4                    [IIa], wherein

V1, V2, V3, and V4 are variable domains, wherein one of V1 to V4 is VA, one is VB, one is VL and one is VH;

D1, D2, D3, and D4 are dimerization domains and may be present or absent, wherein D1 and D3, and D2 and D4, specifically bind to each other and at least one pair of D1 and D3, or D2 and D4 is present; and L1, L2, L3, L4, L5, and L6 are linkers, wherein L1 and L4 are present and L2, L3, L5, and L6 may be present or absent.

10. The antigen binding protein of claim 1, comprising the first polypeptide selected from SEQ ID NO: 158, and the second polypeptide selected from SEQ ID NO: 300.

11. An isolated nucleic acid comprising a sequence encoding the antigen binding protein of claim 1.

12. A vector comprising the nucleic acid of claim 11.

13. A host cell comprising the vector of claim 12, optionally wherein the host cell is a lymphocyte, optionally a T lymphocyte or T lymphocyte progenitor cell, or a cell for recombinant expression, optionally a Chinese Hamster Ovary (CHO) cell or a yeast cell.

14. A pharmaceutical composition comprising the antigen binding protein of claim 1 and a pharmaceutically acceptable carrier.

15. A method of producing the antigen binding protein according to claim 1, comprising a. providing a host cell, b. providing a genetic construct comprising a coding sequence encoding the antigen binding protein, c. introducing said genetic construct into said host cell, and d. expressing said genetic construct by said host cell, e. optionally further comprising the isolation and purification of the antigen binding protein from the host cell and, optionally, reconstitution of the antigen binding protein in a T cell.

16. A method of treating a patient who has cancer, comprising administering to the patient the pharmaceutical composition of claim 14, wherein said cancer is selected from the group of cancers consisting of acute myeloid leukemia, breast cancer, cholangiocellular carcinoma, gallbladder cancer, glioblastoma, hepatocellular carcinoma, head and neck squamous cell carcinoma, melanoma, amelanotic melanoma, non-Hodgkin lymphoma, non-small cell lung cancer adenocarcinoma, non-small cell lung cancer, squamous cell non-small cell lung cancer, ovarian cancer, esophageal cancer, renal cell carcinoma, small cell lung cancer, urinary bladder carcinoma, uterine and endometrial cancer, osteosarcoma, chronic lymphocytic leukemia, colorectal carcinoma, and synovial sarcoma.

17. The antigen binding protein of claim 7, wherein the VA comprises an amino acid sequence at least 95% identical to SEQ ID NO: 132 and the VB comprises an amino acid sequence at least 95% identical to SEQ ID NO: 135.

18. The antigen binding protein of claim 7, wherein the VA comprises an amino acid sequence at least 98% identical to SEQ ID NO: 132 and the VB comprises an amino acid sequence at least 98% identical to SEQ ID NO: 135.

19. The method of claim 16, wherein the VA comprises an amino acid sequence at least 90% identical to SEQ ID NO: 132 and the VB comprises an amino acid sequence at least 90% identical to SEQ ID NO: 135.

20. The method of claim 16, wherein the VA comprises an amino acid sequence at least 95% identical to SEQ ID NO: 132 and the VB comprises an amino acid sequence at least 95% identical to SEQ ID NO: 135.

21. The method of claim 16, wherein the VA comprises an amino acid sequence at least 98% identical to SEQ ID NO: 132 and the VB comprises an amino acid sequence at least 98% identical to SEQ ID NO: 135.

22. The method of claim 16, wherein the VA comprises an amino acid sequence at least 100% identical to SEQ ID NO: 132 and the VB comprises an amino acid sequence at least 100% identical to SEQ ID NO: 135.

23. The method of claim 16, wherein the cancer is breast cancer.

24. The method of claim 16, wherein the cancer is melanoma.

25. The method of claim 16, wherein the cancer is non-small cell lung cancer adenocarcinoma.

26. The method of claim 16, wherein the cancer is non-small cell lung cancer.

27. The method of claim 16, wherein the cancer is squamous cell non-small cell lung cancer.

28. The method of claim 16, wherein the cancer is colorectal carcinoma.

29. The antigen binding protein of claim 1, wherein the antigen binding protein is a bispecific TCR, a bispecific antibody, or a bispecific TCR-antibody molecule.

* * * * *